US009631212B2

(12) United States Patent
Zelder et al.

(10) Patent No.: US 9,631,212 B2
(45) Date of Patent: Apr. 25, 2017

(54) GENE CLUSTER FOR BIOSYNTHESIS OF CORNEXISTIN AND HYDROXYCORNEXISTIN

(71) Applicant: BASF SE, Ludwigshafen (DE)

(72) Inventors: Oskar Zelder, Speyer (DE); Birgit Hoff, Pfungstadt (DE); Hartwig Schroeder, Nussloch (DE); Andrea Molt, Weinheim (DE); Holger Hartmann, Schwetzingen (DE); Klaus Ditrich, Goennheim (DE); Michael Breuer, Darmstadt (DE); Rüdiger Reingrubber, Ludwigshafen (DE); Jakob Weber, Neuhausen (DE)

(73) Assignee: BASF SE, Ludwigshafen (DE)

( * ) Notice: Subject to any disclaimer, the term of this patent is extended or adjusted under 35 U.S.C. 154(b) by 0 days.

(21) Appl. No.: 14/441,215

(22) PCT Filed: Nov. 13, 2013

(86) PCT No.: PCT/IB2013/060093
§ 371 (c)(1),
(2) Date: May 7, 2015

(87) PCT Pub. No.: WO2014/080316
PCT Pub. Date: May 30, 2014

(65) Prior Publication Data
US 2015/0275248 A1    Oct. 1, 2015

Related U.S. Application Data

(60) Provisional application No. 61/728,256, filed on Nov. 20, 2012.

(30) Foreign Application Priority Data

Nov. 20, 2012  (EP) .................................. 12193405
Sep. 3, 2013   (EP) .................................. 13182735

(51) Int. Cl.
| C12N 15/80 | (2006.01) |
| C12P 17/04 | (2006.01) |
| C12N 15/67 | (2006.01) |
| C07D 307/93 | (2006.01) |
| C12N 15/52 | (2006.01) |
| C07K 14/37 | (2006.01) |
| A01N 37/46 | (2006.01) |
| A01N 63/04 | (2006.01) |
| A01N 37/42 | (2006.01) |

(52) U.S. Cl.
CPC .............. *C12P 17/04* (2013.01); *A01N 37/42* (2013.01); *A01N 37/46* (2013.01); *A01N 63/04* (2013.01); *C07D 307/93* (2013.01); *C07K 14/37* (2013.01); *C12N 15/52* (2013.01); *C12N 15/67* (2013.01); *C12N 15/80* (2013.01)

(58) Field of Classification Search
CPC ........ C12N 15/52; C12N 15/67; C12N 15/80; C12N 9/0004; C12N 9/001; C12N 9/1007; C12N 9/1085; C12N 9/90; C12P 17/04; C12P 17/10; C12P 17/12; C12P 17/182; C12P 7/50; A01N 37/42; A01N 37/46; A01N 63/04
See application file for complete search history.

(56) References Cited

U.S. PATENT DOCUMENTS

| 4,897,104 A | 1/1990 | Haneishi et al. |
| 4,990,178 A | 2/1991 | Haneishi et al. |
| 5,424,278 A | 6/1995 | Fields et al. |
| 2008/0148432 A1 | 6/2008 | Abad |

FOREIGN PATENT DOCUMENTS

JP    H-02256602 A    10/1990

OTHER PUBLICATIONS

Devos et al., (Proteins: Structure, Function and Genetics, 2000, vol. 41: 98-107).*
Whisstock et al., (Quarterly Reviews of Biophysics 2003, vol. 36 (3): 307-340 ).*
Witkowski et al (Biochemistry 38:11643-11650, 1999).*
Seffernick et al., (J. Bacteriol. 183(8): 2405-2410, 2001).*
Broun et al (Science 282:1315-1317, 1998).*
Baldari, C., et al. "A Novel Leader Peptide Which Allows Efficient Secretion of a Fragment of Human Interleukin 1β in Saccharomyces Cerevisiae," *The EMBO Journal*, 1987, vol. 6, No. 1, pp. 229-234.
Clark, J. S., et al., Synthetic Studies on the Cornexistins: Synthesis of (±)-5-epi-Hydroxycornexistin, *Organic & Biomolecular Chemistry*, 2008, vol. 6, No. 21, pp. 4012-4025.
Database EMBL, "454GmaGlobSeed85906 Soybean Seeds Containing Globular-Stage Embryos Glycine max cDNA, mRNA sequence," retrieved Jul. 2, 2008 from EBI accession No. FK351274.
Database Genseq, "*Aspergillus fumigatus* ORF nucleotide sequence, SEQ ID NO:3811," retrieved Oct. 14, 2010, from EBI accession No. AWP32365.
Database Genseq, *Aspergillus oryzae* dityrosine transporter gene, SEQ 752, retrieved Apr. 15, 2010, from EBI accession No. AXV91215.

(Continued)

*Primary Examiner* — Padma V Baskar
(74) *Attorney, Agent, or Firm* — Marshall, Gerstein & Borun LLP

(57) ABSTRACT

The invention pertains to the field of production of natural products and, in particular, in the field of production of cornexistin and hydroxycornexistin. It provides polynucleotides encoding polypeptides involved in the biosynthesis of cornexistin and hydroxycornexistin as well as vectors and recombinant microorganisms comprising such polynucleotides. Also provided are methods for the production of natural products, in particular methods for the production of cornexistin and hydroxycornexistin, using such polynucleotides and polpeptides encoded therein, as well as vectors and recombinant microorganisms comprising such polynucleotides and polypeptides.

20 Claims, 74 Drawing Sheets

(56) References Cited

OTHER PUBLICATIONS

Database Genseq, "*Emericella nidulans* regulatory sequence, SEQ ID NO:2910," retrieved Nov. 12, 2009 from EBI accession No. AXB28604.

Furuta, T., et al., "Isolation of Cycloclavine from the Culture Broth of *Aspergillus Japonicus* Saito," *Agricultural and Biological Chemistry*, 1982, vol. 46, No. 7, pp. 1921-1922.

Kurjan, J., et al., "Structure of a Yeast Pheromone Gene (MF α): a Putative α-Factor Precursor Contains Four Tandem Copies of Mature α-Factor," *Cell*, 1982, vol. 30, No. 3, pp. 933-943.

MacPherson, S., et al., "A Fungal Family of Transcriptional Regulators: The Zinc Cluster Proteins," *Microbiology and Molecular Biology Reviews*, 2006, vol. 70, No. 3, pp. 583-604.

Nakajima, M., et al., "Cornexistin: A New Fungal Metabolite with Herbicidal Activity," *The Journal of Antiobics*, 1991, vol. 44, No. 10, pp. 1062-1072.

Samson, R.A., et al., "Polyphasic Taxonomy of the Heat Resistant Ascomycete Genus *Byssochlamys* and its *Paecilomyces* Anamorphs," 2009, *Persoonia*, vol. 22, pp. 14-25.

Schultz, L. D., et al., "Expression and Secretion in Yeast of a 400-kDa Envelope Glycoprotein Derived from Epstein-Barr virus," *Gene*, 1987, vol. 54, No. 1, pp. 113-123.

Shao, Z., et al., "DNA Assembler, an in Vivo Genetic Method for Rapid Construction of Biochemical Pathways," *Nucleic Acids Research*, 2009, vol. 37, No. 2, pp. e-16.

Van Den Hondel, C. A. M. J. J., et al., "Gene Transfer Systems and Vector Development for Filamentous Fungi," *Applied Molecular Genetics of Fungi*, 1991, pp. 1-28.

Van Den Hondel, C. A. M. J. J., et al., "Heterologous Gene Expression in Filamentous Fungi," *More Gene Manipulations in Fungi*, 1991, pp. 396-428.

European Search Report in European Application No. EP 12193405, dated Sep. 6, 2013.

International Search Report in International Application No. PCT/IB2013/060093, dated Mar. 20, 2014.

Database Genseq, "*Aspergillus nidulans* FGSC A4 protein SEQ ID:22268," retrieved Feb. 3, 2011, from EBI accession No. GSP:ATZ35944.

Database Genseq, "SubName: Full=Pc22g13590 protein {ECO:0000313|EMBL:CAP98647.1}", retrieved Dec. 16, 2008 from UNIPROT accession No. UNIPROT:B6HTL2.

Database Genseq, "SubName: Full=Pc22g13590 protein {ECO:0000313|EMBL:EAU29280.1}", retrieved Oct. 17, 2006 from UNIPROT accession No. UNIPROT:Q0C7Q1.

Database Genseq, "SubName: Full=Uncharacterized protein {ECO:0000313|EMBL:EPS29244.1}", retrieved Oct. 16, 2013 from UNIPROT accession No. UNIPROT:S7ZG53.

Supplementary European Search Report, European patent application No. EP 13857215, dated Apr. 22, 2016.

* cited by examiner

Figure 4a: Polypeptides of Gene 1_9399

Figure 4b: Polypyptides of Gene 1_9399 (continued)

Figure 4c: Polypeptides of Gene 1_9399 (continued)

Figure 4d: Polypeptides of Gene 1_9399 (continued)

Figure 5a: Polypeptides of Gene 2_9399

Figure 5b: Polypeptides of Gene 2_9399 (continued)

Figure 6: Polypeptides of Gene 3_9399

Figure 7a: Polypeptides of Gene 4_9399

Figure 7b: Polypeptides of Gene 4_9399 (continued)

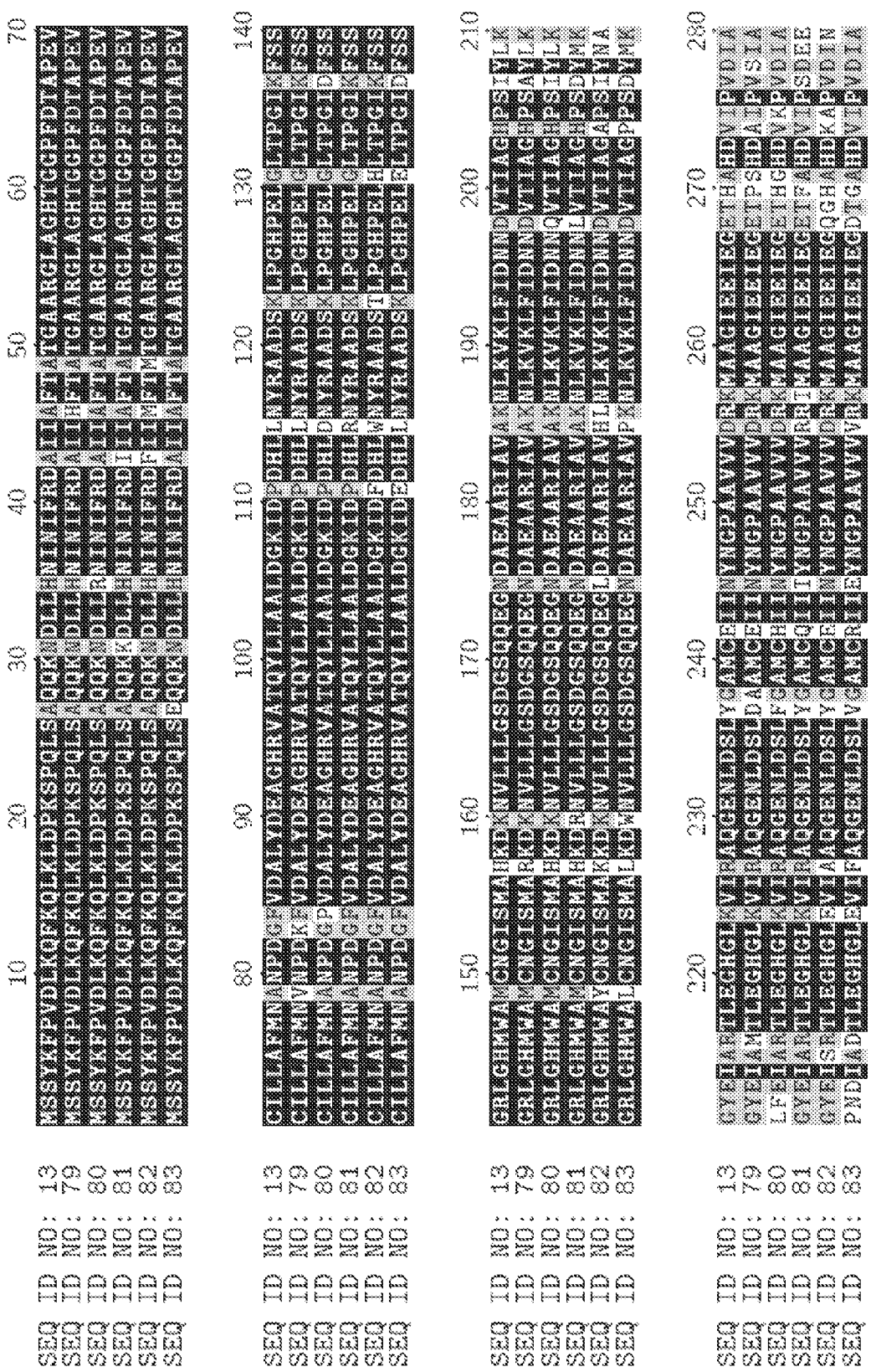
Figure 8a: Polypeptides of Gene 6_9399

Figure 8b: Polypeptides of Gene 6_9399 (continued)

Figure 8c: Polypeptides of Gene 6_9399 (continued)

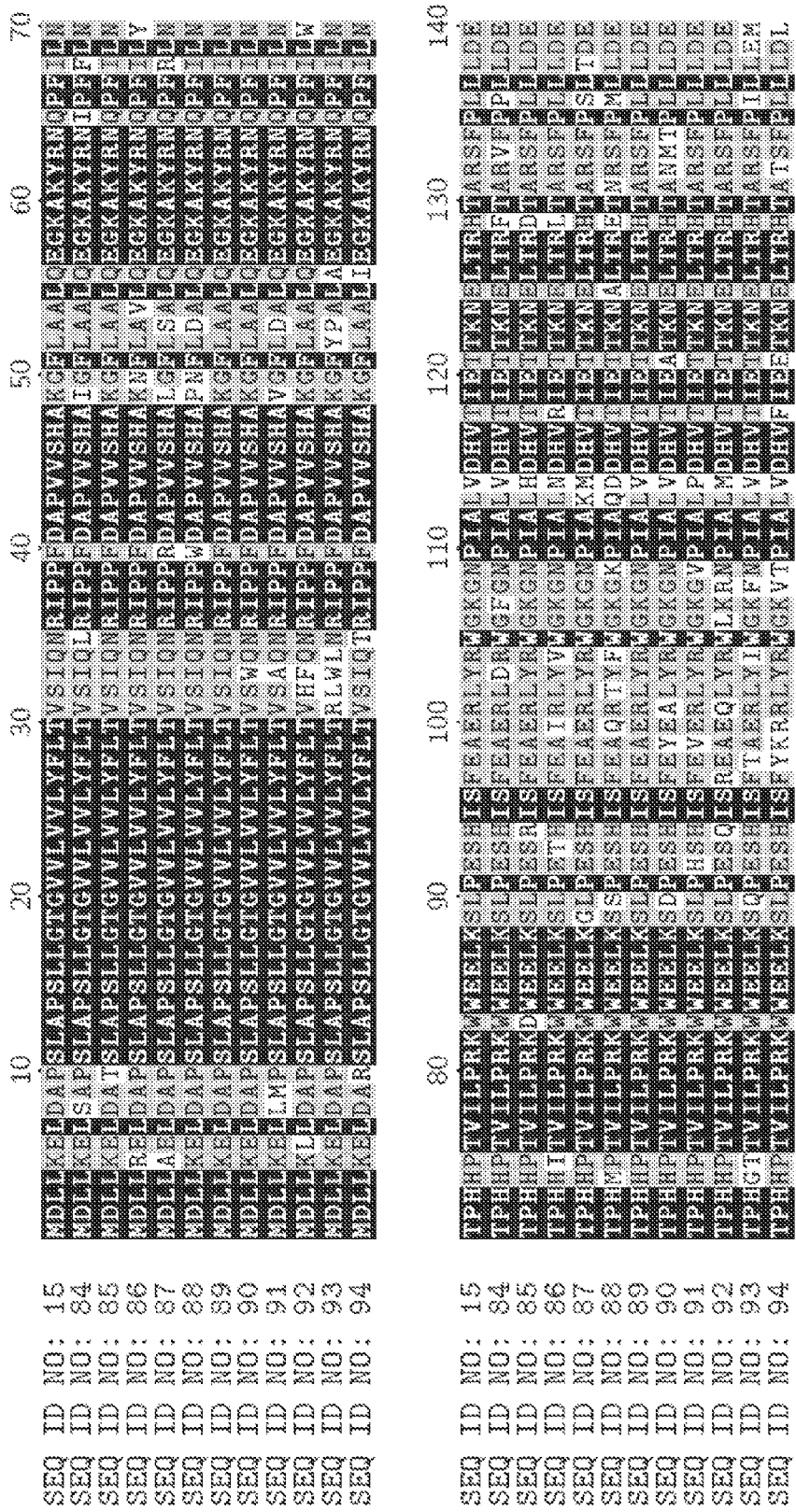
Figure 9a: Polypeptides of Gene 7_9399

Figure 9b: Polypeptides of Gene 7_9399 (continued)

Figure 9c: Polypeptides of Gene 7_9399 (continued)

Figure 9d: Polypeptides of Gene 7_9399 (continued)

```
                    430        440        450        460        470        480        490
SEQ ID NO: 15   VSHSTSELSFGFGTHACPGRFFAAFEIKMILIYLLLNYDLKFQEGVPPPRNEILVTAVMPSFQGKVMMKR
SEQ ID NO: 84   VSHSTSELSFGFGTHACPGRFFAAFEIKMILIYLLLNYDLKFQEGVPPPRNEILVTAVMPSFQGKVMMKR
SEQ ID NO: 85   VDHNTSELSFGFGTHACPGRFFAAFEIKMILIYLLLNYDLKFQEGVPPPRNEILMVAVMPSFQGKVMMKR
SEQ ID NO: 86   VSHSQSELSFGFGTHACPGRFFAAFEIKMILIYLLLNYDLKFQEGVPPPRNEILVTAVMPSDQGKVMMKR
SEQ ID NO: 87   VSHSRAELSFGFGTHACPGRFFAAFEIKMILTYLLLNYDLKFQEGVPPPRNEILVTAVMPSFQGKVMMKR
SEQ ID NO: 88   SSHHTSELSFGFGTHKCPGRFFAAFEIKMILIYLLLNYDLKFQEGQPVPPPRNEILVTAVKPSFQGWSMKR
SEQ ID NO: 89   VSHR.............................................................R
SEQ ID NO: 90   VSHR.............................................................R
SEQ ID NO: 91   VSHR.............................................................R
SEQ ID NO: 92   VSHR.............................................................R
SEQ ID NO: 93   VSHR.............................................................R
SEQ ID NO: 94   VSHR.............................................................R

500
SEQ ID NO: 15   RREKIGWHVD
SEQ ID NO: 84   RREKIGWHVD
SEQ ID NO: 85   RREKIGWHVD
SEQ ID NO: 86   RREKIGWHVD
SEQ ID NO: 87   RREKIGWHVD
SEQ ID NO: 88   RIEKIGWHVD
SEQ ID NO: 89   ..........
SEQ ID NO: 90   ..........
SEQ ID NO: 91   ..........
SEQ ID NO: 92   ..........
SEQ ID NO: 93   ..........
SEQ ID NO: 94   ..........
```

Figure 10a: Polypeptides of Gene 8_9399

Figure 10b: Polypeptides of Gene 8_9399 (continued)

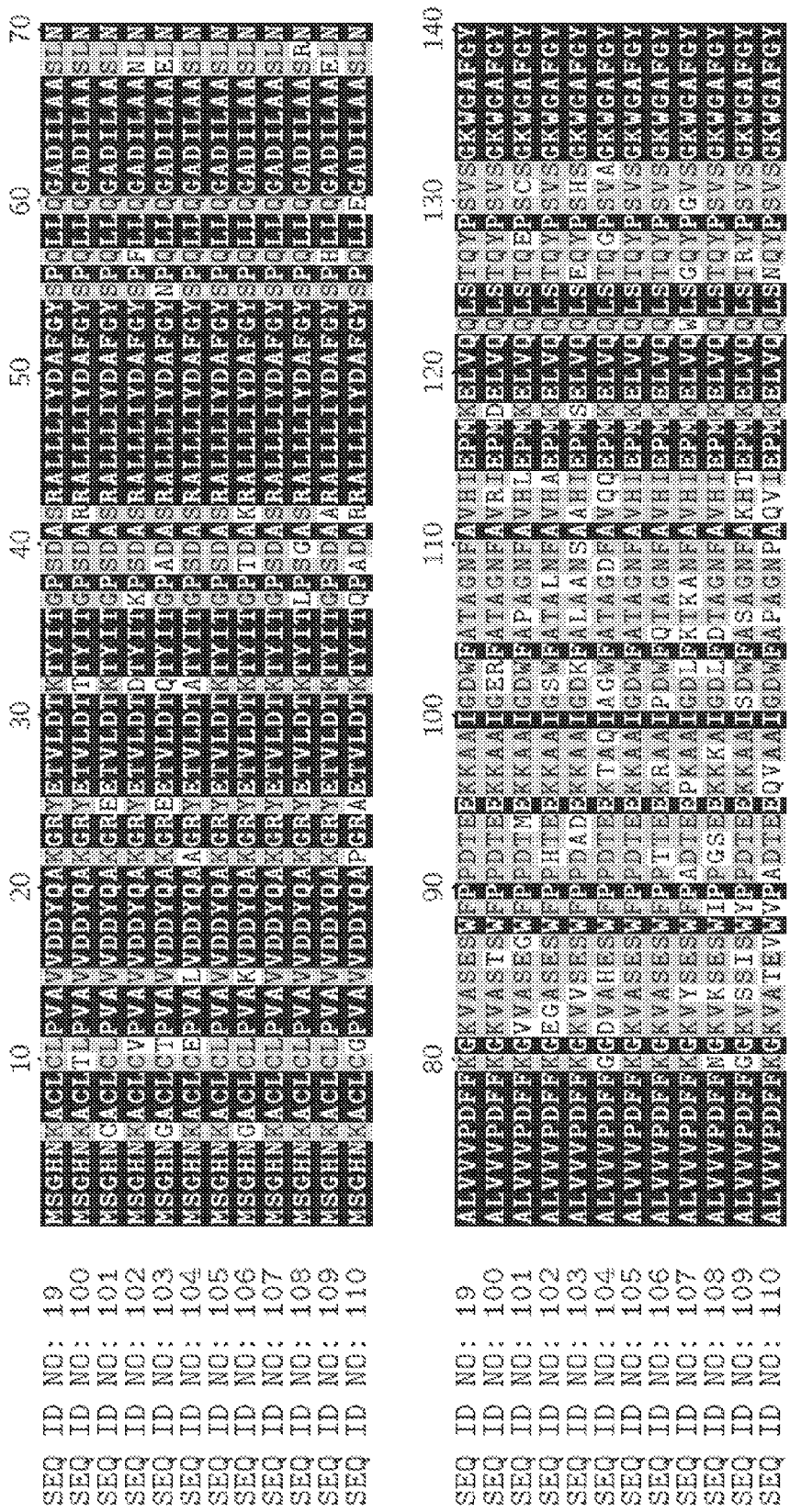
Figure 11a: Polypeptides of Gene 9_9399

Figure 11b: Polypeptides of Gene 9_9399 (continued)

Figure 12a: Polypeptides of Gene 10_9399

Figure 12b: Polypeptides of Gene 10_9399 (continued)

Figure 13a: Polypeptides of Gene 11_9399

Figure 13b: Polypeptides of Gene 11_9399 (continued)

Figure 13c: Polypeptides of Gene 11_9399 (continued)

Figure 13d: Polypeptides of Gene 11_9399 (continued)

Figure 13e: Polypeptides of Gene 11_9399 (continued)

Figure 14a: Polypeptides of Gene 12_9399

Figure 14b: Polypeptides of Gene 12_9399 (continued)

Figure 15a: Polypeptides of Gene 13_9399

Figure 15b: Polpypeptides of Gene 13_9399 (continued)

Figure 16a: Polypeptides of Gene 14_9399

Figure 16b: Polpypeptides of Gene 14_9399 (continued)

Figure 16c: Polypeptides of Gene 14_9399 (continued)

Figure 16d: Polypeptides of Gene 14_9399 (continued)

```
                                430                440
SEQ ID NO: 29   RLFRPTHVYTGETEPVLEMTAPSAKL
SEQ ID NO: 137  RLFRPTHVYTGETEPVLEMTAPSAKL
SEQ ID NO: 138  RLFRPTHDYTGEGEPVLEMTAPSAKL
SEQ ID NO: 139  RLFRPTHVYTGETEPVLEMTAPSAKL
SEQ ID NO: 140  RLFRPTHVYTGETEPPLEMTAPSAKL
SEQ ID NO: 141  RLFRPTHMYTGETEPPLEMPAPSAKL
SEQ ID NO: 142  RLFRPTHVYTGETEPVLEMTAPSAKL
SEQ ID NO: 143  ..........................
SEQ ID NO: 144  ..........................
SEQ ID NO: 145  ..........................
SEQ ID NO: 146  ..........................
SEQ ID NO: 147  ..........................
```

Figure 17a: Polypeptides of Gene 15_9399

Figure 17b: Polypeptides of Gene 15_9399 (continued)

```
                        220        230        240        250        260        270        280
SEQ ID NO: 31    YLMGHSDGTVYTDFMVLCGHQLRRQIPDGSHKRYIPPEPGCALMVGDAFKSFTDGEVPSCVHRVIQP
SEQ ID NO: 148   YLMGHSDGTVYTDFMVLCGHQLRRQIPDGSHKRYIPPEPGCALMVGDAFKSFTDGEVPSCVHRVIQP
SEQ ID NO: 149   YLMGHSDGTVYTDFMVLCGHQLRRNPDGSIEKRYIPPEPGCALMVGDAFKSFTDGEVPSCVHRVIQP
SEQ ID NO: 150   YLMGHSDGTVYTDFMVLCGHQLRHQKDGSIEKRAIPPEPGCALMVGDAFKSFTDGEVPSCLHRVIQP
SEQ ID NO: 151   YLMGHSDGTVYTDFLMLCGHSVDGSIEKRYIPPEPGCALMVGDAFKSFTDGEVPSCVHRVIQP
SEQ ID NO: 152   YLMGHSDVGTVYTDFWVLCGLQLRDQKDGSIEKRYSIPPEPGCALMVGDAFKSFTDGEVPSCVHRVIQP 290        300        310        320        330        340
SEQ ID NO: 31    PGEDDRFDRYALGFELKPAHCASHCPVPRRGVTENCVNKASDYGEIANKKTALVNEMRQENVAI
SEQ ID NO: 148   PGQDRIDRYALGFELKPAHCASHCPVPRRGVTENCVNKASDYGEIANKKTALVNEMRQENVAI
SEQ ID NO: 149   PGEGGRFDRYALGFELGPAHCASHCPVPRRGVTENCVNKASDCGEIAHLLTALVNEMRQENVAI
SEQ ID NO: 150   PGEDGRFDRYALGFELKPSEPAHCASHCPVPARGVTENCVNKASDGEIANKKTALVNEMRQENVAI
SEQ ID NO: 151   PREGGRFDRYALGFELKPAHCASHCPVPBRGVTENCVANKASDYGMARGKTALVNEIRDENVAI
SEQ ID NO: 152   PGEDGRKDRYALGFELKPASGAHITPVPRRCVKENCVNKASDYGEQKAVKVDMNERGENVAI
```

Figure 18a: Polypeptides of Gene 16_9399

| SEQ ID NO: 33 | MGDHLIFLDQIVQGSLRLCPGSMHSVMASSHKIPRTVDEATALPAPPPISVFSPYQKKLIVFTAA |
| SEQ ID NO: 153 | MGDHLIFLTLDQIVQGSLRLCPGSMHSVMASSHKIPRTVDEATALPAPPPISVFSPYQKKLIVFTAA |
| SEQ ID NO: 154 | MGDHLIFLTLDQIVQGSIRLCCPGSAHSVMASSHKIPEVTVQEATADPAPPTPIAQFSMVQAKLIVFTAA |
| SEQ ID NO: 155 | MGDHLIFADQIVQGSLRLCPGSMHSVWGLSHKIPSPRTVDEATQLPKEPPTVFFPVQEWTVFTAA |
| SEQ ID NO: 156 | MGDHLIFLIFLDQIVQGSLRLCPGSMHSVMAGSAPILPRTVDEASAIPSLPSVFSPVRKLIVFTAA |
| SEQ ID NO: 157 | MGDHDIFLDQIVQGSYBLCPGSTHSVMSTSHRIPNPRTEDEGTALPVQPPIGVFSPVQQKLIVFTAA |
| SEQ ID NO: 158 | MHSVMASSHKIPIPRTVDEATALPAPPPISVFSPVQKKLIVFTAA |
| SEQ ID NO: 159 | MHSVQMSSHKIPIPRTVDEATALPAQPPIQVFSPVQKKLIVFTAA |
| SEQ ID NO: 160 | MHSVMASSHKIPTIARVPVDEALALPPPQPIEVWSPGQKNLIVFTAA |
| SEQ ID NO: 161 | MHSVMASSHKIPIPRTVDPHGNLAPPPPPISVFSPVQKRLIVFTAA |
| SEQ ID NO: 162 | MHSGDMSALPAHIPRTVIEATAMPAQLPSEFTPVQKKLIVFTAA |
| SEQ ID NO: 163 | MHSGDMSALPAHIPRTHDAATAEQSPPPISEFTPVQKKLIVFTAA |

| SEQ ID NO: 33 | LASFSPISSMYYPAHSDEKISPGVHLTITAVWEGLTPAFMCDLSDTAGRRPYVLCFGIYI |
| SEQ ID NO: 153 | LSTFSPISSMYYPAHSHADEKISPGVHLTITAVWEGLTPAFMCDLSDTAGRRPYVLCFGIYI |
| SEQ ID NO: 154 | LATFTPESHMYPAHSIEDEKTCPGVMLTITAVWEGLTPAFMCDLSDTAGRRPYVLCFGIYI |
| SEQ ID NO: 155 | LWQFSPLSSAHYPAHSIANELKISPGVYLTITAYWEGLTPAFMCDLSDTAGRRPYVLCFGIYI |
| SEQ ID NO: 156 | LASHSPISSMYPAHSHADERKISAGYVHLTITAVWEGLTPAFMCDLSDTAGRRPYVLCFGIYI |
| SEQ ID NO: 157 | LSTFSPVSSHMYPAHSHADEKISTCGVHLTITAYWEGLTPAFMCFLSDTAGRRPYVLCFGIYI |
| SEQ ID NO: 158 | LASTVPISSMYPAHSHADEKISPGVHLTITAVWEGLTPAFMCDLSDTAGRRPYVLCFGIYI |
| SEQ ID NO: 159 | LASSLRSSMYPAHSHADEKISPGVHLTITAVWEGLTPAFMCDLSDTAGRRPYVLCFGIYI |
| SEQ ID NO: 160 | LAYESSPISSMYPAHLLADEKISPGVHLTITAVWEGLTPAFMCDLSDTAGRRPYVLCFGIYI |
| SEQ ID NO: 161 | LASTLSPITSQYPAHSHQDELKISPGVHLTITAVWEGLTPAFMCDLSDTAGRRPYVLCFGIYI |
| SEQ ID NO: 162 | LVTFSPISSMYPAHSHAQEKTISPCGVHLTITAVWEGLTPAFMCDLSDTAGRRPYVLCFGIYI |
| SEQ ID NO: 163 | LVTFSPISSMYPAHSHAQEKTISPCGVHLTITAVWEGLTPAFMCDLSDTAGRRPYVLCFGIYI |

Figure 18b: Polypeptides of Gene 16_9399 (continued)

Figure 18c: Polypeptides of Gene 16_9399 (continued)

Figure 18d: Polypeptides of Gene 16_9399 (continued)

Figure 19a: Polypeptides of Gene 17_9399

Figure 19b: Polypeptides of Gene 17_9399 (continued)

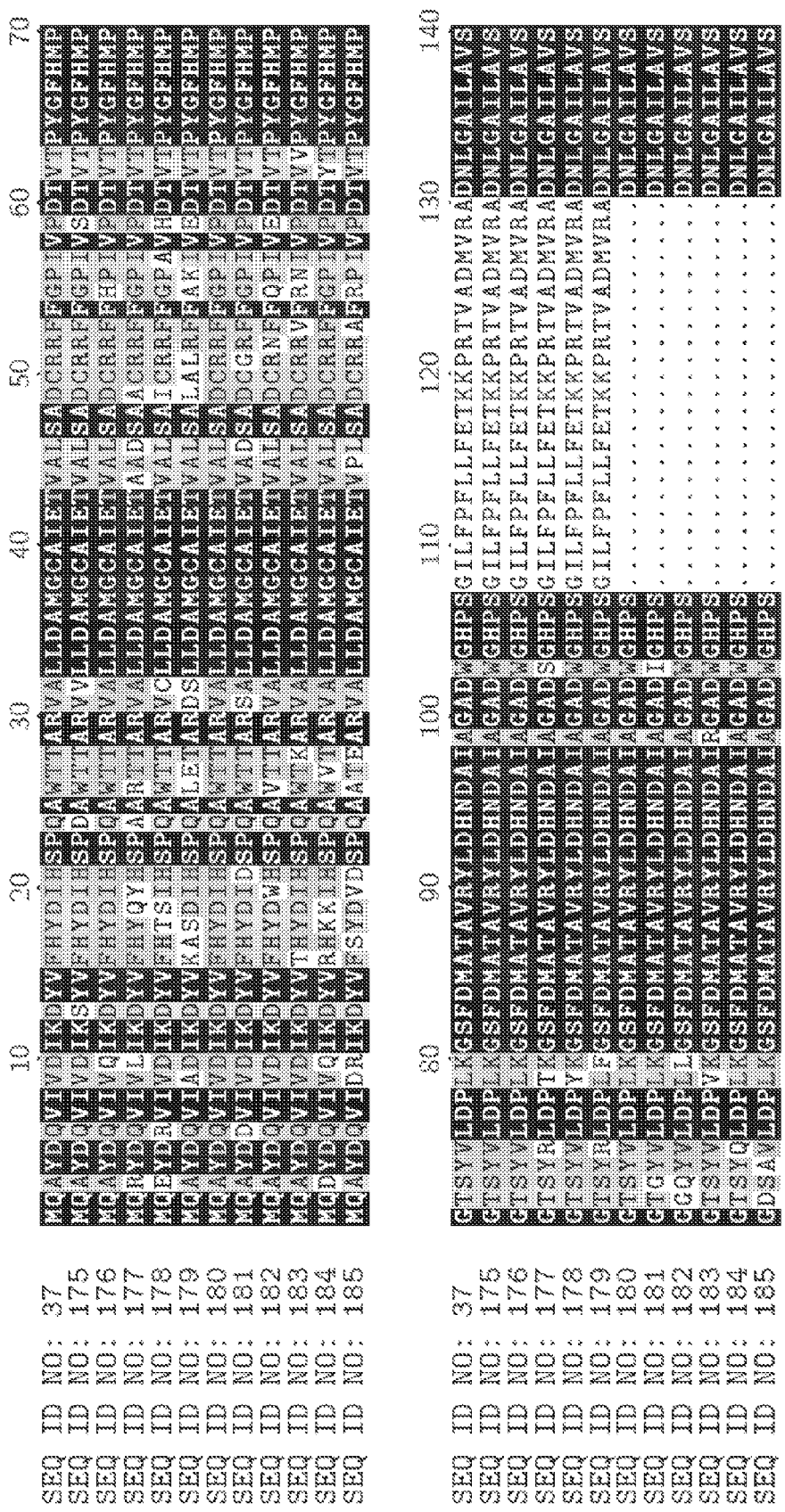
Figure 20a: Polypeptides of Gene 18_9399

Figure 20b: Polypeptides of Gene 18_9399 (continued)

Figure 20c: Polypeptides of Gene 18_9399 (continued)

Figure 20d: Polypeptides of Gene 18_9399 (continued)

Figure 21: Polypeptides of Gene 19_9399

Figure 22a: Polypeptides of Gene 20_9399

Figure 22b: Polypeptides of Gene 20_9399 (continued)

Figure 22c: Polypeptides of Gene 20_9399 (continued)

Figure 22d: Polypeptides of Gene 20_9399 (continued)

Figure 22e: Polypeptides of Gene 20_9399 (continued)

Figure 22f: Polypeptides of Gene 20_9399 (continued)

Figure 22g: Polypeptides of Gene 20_9399 (continued)

Figure 22h: Polypeptides of Gene 20_9399 (continued)

Figure 22i: Polypeptides of Gene 20_9399 (continued)

Figure 22j: Polpypeptides of Gene 20_9399 (continued)

Figure 22k: Polypeptides of Gene 20_9399 (continued)

Figure 22I: Polypeptides of Gene 20_9399 (continued)

Figure 22m: Polypeptides of Gene 20_9399 (continued)

Figure 22n: Polypeptides of Gene 20_9399 (continued)

Figure 22o: Polypeptides of Gene 20_9399 (continued)

Figure 22p: Polypeptides of Gene 20_9399 (continued)

Figure 22q: Polypeptides of Gene 20_9399 (continued)

Figure 22r: Polypeptides of Gene 20_9399 (continued)

Figure 23: Polypeptides of Gene 21_9399

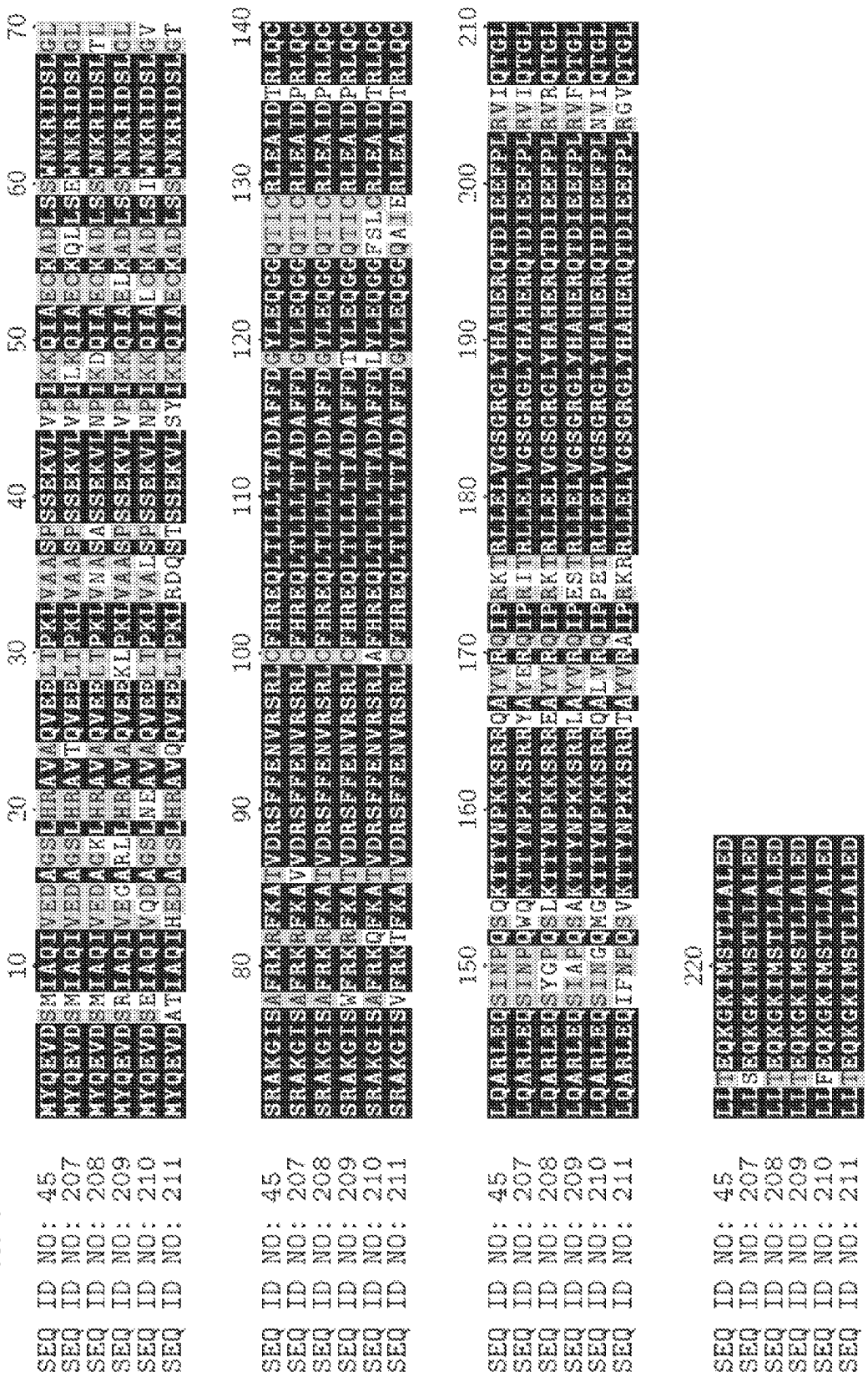
Figure 24: Polypeptides of Gene 22_9399

Figure 25a: Polypeptides of Gene 23_9399

Figure 25b: Polypeptides of Gene 23_9399 (continued)

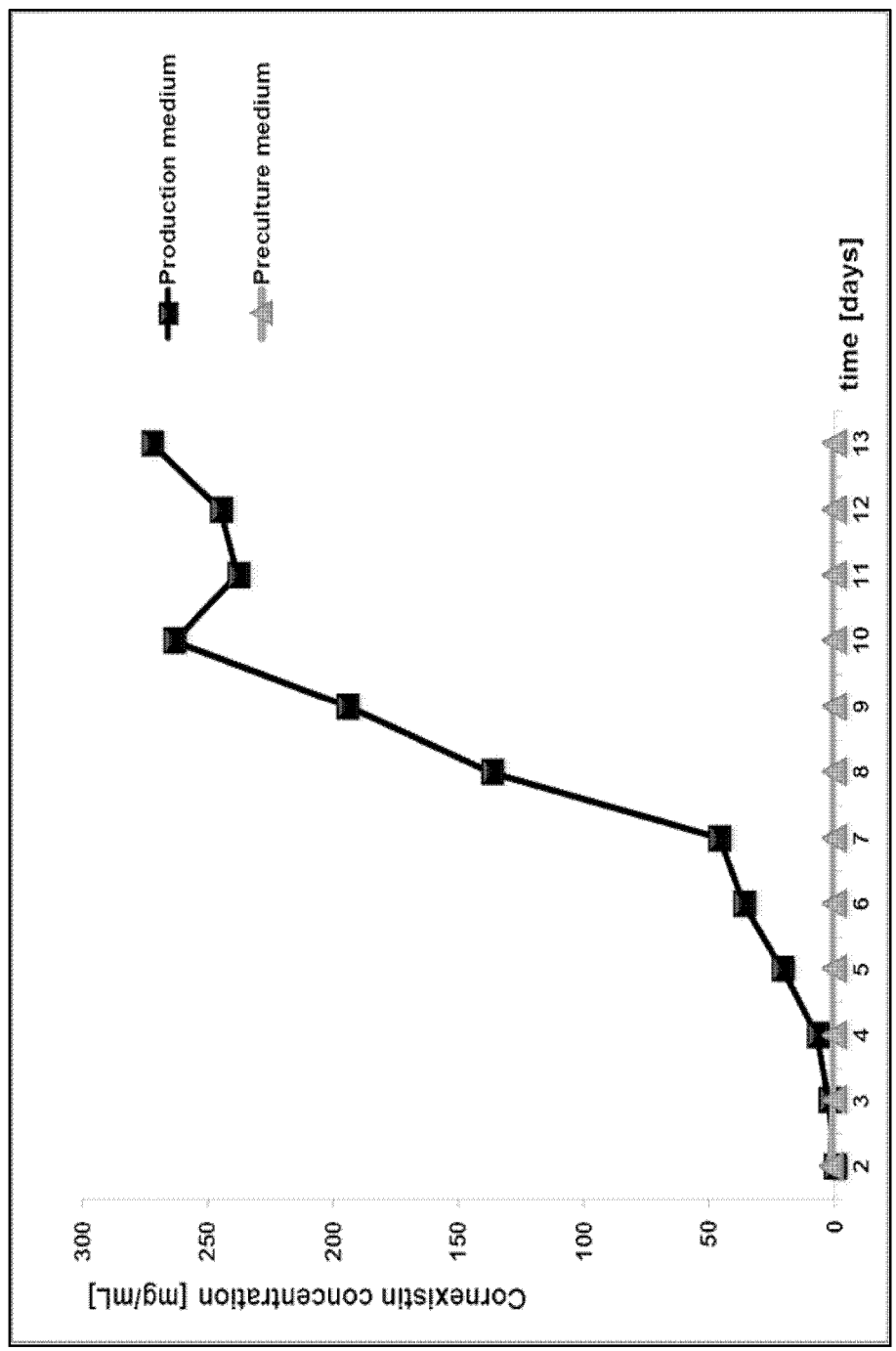
Figure 26: Time course of Cornexistin Production

GENE CLUSTER FOR BIOSYNTHESIS OF CORNEXISTIN AND HYDROXYCORNEXISTIN

This application claims priority of applications with number U.S. 61/728,256, EP 12193405.3, EP 13182735.4, all of which are incorporated by reference in their entirety.

FIELD OF THE INVENTION

The invention pertains to the field of production of natural products and, in particular, in the field of production of cornexistin and hydroxycornexistin. It provides polynucleotides encoding polypeptides involved in the biosynthesis of cornexistin and hydroxycornexistin as well as vectors and recombinant microorganisms comprising such polynucleotides. Also provided are methods for the production of natural products, in particular methods for the production of cornexistin and hydroxycornexistin, using such polynucleotides and polpeptides encoded therein, as well as vectors and recombinant microorganisms comprising such polynucleotides and polypeptides.

BACKGROUND OF THE INVENTION

Cornexistin and hydroxycornexistin are natural products derived from the fungus *Paecilomyces divaricatus* formerly known as *Paecilomyces variotii* SANK 21086. Both, cornexistin and hydroxycornexistin, are highly potent herbicides that have the unique quality of being harmless to corn plants. Because of this quality, both molecules have attracted research interest. The Sankyo Corporation discovered cornexistin during the screening of biological extracts for herbicidal use (JP2256602). Cornexistin showed good activity as a herbicide as well as relative inactivity towards corn plants. Sankyo's characterization showed this fungal natural product to be a member of the nonadride family, a group of natural products known for their interesting structural characteristics including a central nine-membered ring, fused maleic anhydrides and pendant alkyl chains. Cornexistin and hydroxycornexistin has been synthesized by chemical synthesis only as diastereomeres (Org. Biomol. Chem., 2008, 6, 4012-4025). Nine-membered carbocyclic structures in general are rare in nature and their synthesis as well as the genes involved in the synthesis are still unknown and not described.

Isolation of cornexistin from the cultures of *Paecilomyces* species originally identified as *Paecilomyces variotii* SANK21086 was published as early as 1989 by the Sankyo research group JP2256602). Later work from the DOW Elanco group described identification of hydroxycornexistin also produced in *Paecilomyces variotii* SANK 21086 (US00542478). However, the yield of the producing strain SANK 21086 under fermentation conditions is believed to be too low for commercial production purposes.

The technical problem underlying the present invention can be seen as the provision of additional means and methods for the production of cornexistin or hydroxycornexistin, or for the production of cornexistin and hydroxycornexistin. The technical problem is solved by the embodiments characterized in the claims and herein below.

SUMMARY OF THE INVENTION

The invention provides for recombinant polynucleotides comprising nucleic acid sequences being at least 80% identical to the nucleic acid sequence as shown in SEQ ID NO: 1 or being at least 80% identical to the nucleic acid sequence as shown by the sequence of nucleotide 1001 to nucleotide 57525 of SEQ ID NO: 1, or being at least 80% identical to a nucleic acid sequence as shown by the sequence of nucleotide 12423 to nucleotide 52300 of SEQ ID NO: 1, or being at least 80% identical to a nucleic acid sequence as shown by the sequence of nucleotide 7505 to nucleotide 55295 of SEQ ID NO: 1, or being at least 80% identical to a nucleic acid sequence as shown by the sequence of nucleotide 18123 to nucleotide 52300 of SEQ ID NO: 1 or comprising a nucleic acid sequence being at least 80% identical to a nucleic acid sequence as shown in SEQ ID NOs: 2, 4, 6, 8, 10, 12, 14, 16, 18, 20, 22, 24, 26, 28, 30, 32, 34, 36, 38, 40, 42, 44 or 46, or comprising a nucleic acid sequence encoding a polypeptide having an amino acid sequence being at least 80% identical to an amino acid sequence as shown in SEQ ID NOs: 3, 5, 7, 9, 13, 15, 17, 19, 21, 23, 25, 27, 29, 31, 33, 35, 37, 39, 41, 43, 45, 47, 89, 105, 121, 142, 158, 169, 180, 196 or comprising a nucleic acid sequence comprising at least one expression cassette for at least one polypeptide having an amino acid sequence being at least 80% identical to an amino acid sequence as shown in SEQ ID NOs: 3, 5, 7, 9, 13, 15, 17, 19, 21, 23, 25, 27, 29, 31, 33, 35, 37, 39, 41, 43, 45, 47, 89, 105, 121, 142, 158, 169. 180, or 196, or comprising a nucleic acid sequence being at least 70% identical to a nucleic acid sequence as shown in SEQ ID NO: 1 and comprising at least one expression cassette for at least one polypeptide having an amino acid sequence being at least 80% identical to an amino acid sequence as shown in SEQ ID NOs: 3, 5, 7, 9, 13, 15, 17, 19, 21, 23, 25, 27, 29, 31, 33, 35, 37, 39, 41, 43, 45, 47, 89, 105, 121, 142, 158, 169. 180, or 196, or comprising a nucleic acid sequence being at least 80% identical to a nucleic acid sequence as shown by the sequence of nucleotide 1001 to nucleotide 57525 of SEQ ID NO: 1 and comprising at least one expression cassette for at least one polypeptide having an amino acid sequence being at least 80% identical to an amino acid sequence as shown in SEQ ID NOs: 3, 5, 7, 9, 13, 15, 17, 19, 21, 23, 25, 27, 29, 31, 33, 35, 37, 39, 41, 43, 45, 47, 89, 105, 121, 142, 158, 169, 180, or 196, or comprising a nucleic acid sequence being at least 70% identical to the nucleic acid sequence as shown by the sequence of nucleotide 12423 to nucleotide 52300 of SEQ ID NO: 1 and comprising at least one expression cassette for at least one polypeptide having an amino acid sequence being at least 80% identical to an amino acid sequence as shown in SEQ ID NOs: 13, 15, 19, 25, 27, 29, 35, 37, 41, 89, 105, 142, 169, 180, or 196, or comprising a nucleic acid sequence being at least 70% identical to a nucleic acid sequence as shown by the sequence of nucleotide 7505 to nucleotide 55295 of SEQ ID NO: 1 and comprising at least one expression cassette for at least one polypeptide having an amino acid sequence being at least 80% identical to an amino acid sequence as shown in SEQ ID NOs: 7, 9, 19, 21, 27, 29, 31, 33, 35, 37 or 41, or comprising a nucleic acid sequence being at least 70% identical to a nucleic acid sequence as shown by the sequence of nucleotide 18123 to nucleotide 52300 of SEQ ID NO: 1 and comprising at least one expression cassette for at least one polypeptide having an amino acid sequence being at least 80% identical to an amino acid sequence as shown in SEQ ID NOs: 17, 19, 21, 27, 29, 33, 35, 37 or 41. The invention does also provide for polynucleotides comprising a nucleic acid sequence which enables these polynucleotides to hybridize under high stringency hybridisation conditions to at least one of the polynucleotides described above. Further embodiments of the invention are recombinant polynucleotides as described above, comprising an expression cassette for a polypeptide having an amino acid sequence being at least 80% identical to an amino acid sequence selected from the group of sequences shown in SEQ ID NOs: 13, 15, 19, 25, 27, 29, 35, 37 41, 89, 105, 142, 169 and 196 and comprising at least one further expression cassette having an amino acid sequence being at least 80% identical to an amino acid sequence selected from the group of sequences shown in SEQ ID NOs: 13, 15, 19, 25, 27, 29, 35, 37 41, 89, 105, 142, 169, 180 and 196. Additional embodiments are recombinant polynucleotides as described above, comprising an expression cassette for each one of the polypeptides having an amino acid sequence as shown in SEQ ID NOs: 13, 15, 19, 25, 27, 29, 35, 37, 41, 89, 105, 142, 169, 180 and 196. All of the polynucleotides described so far may or may not be comprised in a vector or a recombinant microorganism. Accordingly, these vectors and recombinant microorganisms are also part of the invention. The recombinant microorganisms may be bacterial, fungi or yeasts. Preferably, the recombinant microorganism is *Paecilomyces divaricatus*. Also part of the invention are processes to produce a recombinant microorganism as described above, wherein the process comprises the following steps: a) transforming a microorganism with a polynucleotide of the invention, and b) selecting a microorganism comprising a polynucleotide of the invention. A further process of the invention is a process to produce a recombinant microorganism for the production of cornexistin or hydroxycornexistin or the production of cornexistin and hydroxycornexistin comprising the steps of: a) transforming a microorganism with at least one of the polynucleotides or vectors described above, b) selecting a microorganism comprising at least one of these polynucleotides, or at least one of the vectors and selecting a recombinant microorganism producing cornexistin or hydroxycornexistin, or producing cornexistin and hydroxycornexistin. Also part of the invention is a process for the production of cornexistin or hydroxycornexistin, or for the production of cornexistin and hydroxycornexistin comprising the steps of: a) cultivating at least one of the recombinant microorganisms described above under conditions which allow for the production of cornexistin or hydroxycornexistin, or which allow for the production of cornexistin and hydroxycornexistin by said recombinant microorganism and b) obtaining all or part of the produced cornexistin or produced hydroxycornexistin or obtaining all or part of the produced cornexistin and hydroxycornexistin. Preferably, the cornexistin or hydroxycornexistin or cornexistin and hydroxycornexistin are obtained from the culture broth used to cultivate the recombinant microorganism. In further group of embodiments, at least one of cornexistin or hydroxycornexistin is obtained as dibasic acid thereof, or in the form of its agriculturally acceptable salt. The recombinant polynucleotides provided by the invention can be used in a method to identify microorganisms capable to produce cornexistin or hydroxycornexistin, or capable to produce cornexistin and hydroxycornexistin. Hence, a further part of the invention is a method to identify microorganisms capable to produce cornexistin or hydroxycornexistin or capable to produce cornexistin and hydroxycornexistin comprising the steps of: a) providing genomic DNA or cDNA of a microorganism or of a recombinant microorganism and b) testing the genomic DNA or cDNA for the presence of at least one polynucleotide having a nucleic acid sequence being at least 80% identical to at least one of a nucleic acid sequences as shown in SEQ ID NOs: 1, 2, 4, 6, 8, 10, 12, 14, 16, 18, 20, 22, 24, 26, 28, 30, 32, 34, 36, 38, 40, 42, 44 or 46, or encoding at least one polypeptide having an amino acid sequence being at least 80% identical to an amino acid sequence as shown in SEQ ID NOs: 3, 5, 7, 9, 13, 15, 17, 19, 21, 23, 25, 27, 29, 31, 33, 35, 37, 39, 41, 43, 45, 47, 89, 105, 121, 142, 158, 169, 180 or 196. Other parts of the invention are the use of any one of the recombinant polynucleotides described above or a vector as described above to produce a recombinant microorganism or the use in at least one of the processes or methods as described above. A further part of the invention is the use of at least one of the recombinant polynucleotides described above, or at least one of the vectors described above, or at least one of the recombinant microorganisms described above for the manufacture of cornexistin or hydroxycornexistin or for the manufacture of cornexistin and hydroxycornexistin. Also part of the invention is a method to enhance the production of cornexistin or hydroxycornexistin or cornexistin and hydroxycornexistin in *Paecilomyces divaricatus* or *Byssochlamys verrucosa* by upregulating the activity of at least one polypeptide having an amino acid sequence being at least 80%, identical to an amino acid sequence as shown in SEQ ID NOs: 13, 15, 19, 25, 27, 29, 35, 37, 41, 89, 105, 142, 169, 180 and 196. Preferably, at least two polypeptides polypeptide having an amino acid sequence being at least 80% identical to an amino acid sequence as shown in at least one of SEQ ID NOs: 13, 15, 25, 35 41, 89, 169 and 196 are upregulated. More preferred, the activity of at least one polypeptide having an amino acid sequence being at least 80%, identical to an amino acid sequence as shown in SEQ ID NOs: 13 or 25 is upregulated. Additional parts of the invention comprise methods to enhance the production of hydroxycornexistin in *Paecilomyces divaricatus* or *Byssochlamys verrucosa* by upregulating the activity of a polypeptide having an amino acid sequence being at least 80% identical to an amino acid sequence as shown in SEQ ID NO: 15 or 89. Further parts of the invention comprise recombinant expression cassettes comprising a promoter being operatively linked to a polypeptide encoding polynucleotide, wherein the promoter has a nucleic acid sequence, which is identical to the nucleic acid sequence as shown in SEQ ID NO: 236 or which is at least 80% identical to the nucleic acid sequence as shown in SEQ ID NO: 236, or which enables the promoter to hybridize under high stringency hybridization conditions to a polynucleotide comprising a nucleic acid sequence as shown in SEQ ID NO: 236, or which is at least 60% identical to a nucleic acid sequence as shown in SEQ ID NO: 236 and being obtainable from an expression cassette of a wildtype *Paecilomyces divaricatus* or *Byssochlamys verrucosa* genome, wherein the expression cassette comprises a polynucleotide encoding a polypeptide sequence being at least 90% identical to an amino acid sequence as shown in SEQ ID NO: 238, or which is at least 60% identical to a nucleic acid sequence as shown in SEQ ID NO: 236 and being obtainable from an expression cassette of a wildtype *Paecilomyces divaricatus* or *Byssochlamys verrucosa* genome, wherein the expression cassette comprises a nucleic acid sequence being at least 90% identical to a nucleic acid sequence as shown in SEQ ID NO: 237. An additional embodiment of the invention is a recombinant expression cassette comprising a polynucleotide having a nucleic acid sequence encoding a polypeptide having an amino acid sequence being at least 90% identical to an amino acid sequence as shown in SEQ ID NO: 238 or which is at least 80% identical to a nucleic acid sequence as shown in SEQ ID NO: 237, or which enables a polynucleotide to hybridize under high stringency hybridisation conditions to a polynucleotide having a nucleic acid sequence as shown in SEQ ID NO: 237. Also comprised by the invention is a recombinant expression cassette comprising a promoter being operatively linked to a polypeptide encoding polynucleotide, wherein the promoter has a nucleic acid sequence fulfilling one or more of the following criteria a) which is identical to at least one of the nucleic acid sequences shown in SEQ ID NO: 217, 218, 219, 220, 221 or 222, or b) which is at least 80% identical to the nucleic acid sequence as shown in SEQ ID NO: 217, 218, 219, 220, 221 or 222, or c) which hybridizes under stringent conditions to a nucleic acid sequence as shown in any one of SEQ ID NOs: 217, 218, 219, 220, 221 or 222, d) which is at least 60% identical to a nucleic acid sequence as shown in SEQ ID NO: 217, 218, 219, 220, 221 or 222 and being obtainable from an expression cassette of a wildtype *Paecilomyces divaricatus* or *Byssochlamys verrucosa* genome, wherein the expression cassette comprises a polynucleotide encoding a polypeptide sequence being at least 90% identical to an amino acid sequence as shown in SEQ ID NO: 15, 17, 19, 21, 23, 33, 35, 37, 39, 43, or 45, or e) which is at least 60% identical to a nucleic acid sequence as shown in SEQ ID NO: 217, 218, 219, 220, 221 or 222 and being obtainable from an expression cassette of a wildtype *Paecilomyces divaricatus* or *Byssochlamys verrucosa* genome, wherein the expression cassette comprises a polynucleotide being at least 90% identical to a nucleic acid sequence as shown in SEQ ID NO: 14, 16, 18, 20, 22, 32, 34, 36, 38, 42, or 44, or f) which is the reverse complement of at least one of a) to e). The invention comprises also recombinant expression cassettes comprising a promoter having a nucleic acid sequence as described above and being operatively linked to a recombinant polynucleotide encoding at least one polypeptide having an amino acid sequence being at least 80% identical to an amino acid sequence as shown in SEQ ID NOs: 3, 5, 7, 9, 11, 13, 15, 17, 19, 21, 23, 25, 27, 29, 31, 33, 35, 37, 39, 41, 43, 45, or 47. Also part of the invention is a system for coordinated gene expression in a recombinant microorganism, comprising I) at least one expression cassette comprising a promoter being able to provide for gene expression in said microorganism and being operably linked to a polynucleotide encoding a polypeptide having an amino acid sequence being at least 80% identical to SEQ ID NO: 25, 127, 128, 129, 130, or 131 and ii) one or more expression cassettes comprising a promoter being operatively linked to a polypeptide encoding polynucleotide, wherein the promoter comprises a nucleic acid sequence fulfilling one of more of the following criteria a) being identical to at least one of the nucleic acid sequences shown in SEQ ID NO: 217, 218, 219, 220, 221 or 222, or b) being at least 80% identical to the nucleic acid sequence as shown in SEQ ID NO: 217, 218, 219, 220, 221 or 222, or c) being able to hybridize under stringent conditions to a nucleic acid sequence as shown in any one of SEQ ID NOs: 217, 218, 219, 220, 221 or 222, or d) being at least 60% identical to a nucleic acid sequence as shown in SEQ ID NO: 217, 218, 219, 220, 221 or 222 and being obtainable from an expression cassette of a wildtype *Paecilomyces divaricatus* or *Byssochlamys verrucosa* genome, wherein the expression cassette comprises a polynucleotide encoding a polypeptide sequence being at least 90% identical to an amino acid sequence as shown in SEQ ID NO: 15, 17, 19, 21, 23, 33, 35, 37, 39, 43, or 45 or e) being at least 60% identical to a nucleic acid sequence as shown in SEQ ID NO: 217, 218, 219, 220, 221 or 222 and being obtainable from an expression cassette of a wildtype *Paecilomyces divaricatus* or *Byssochlamys verrucosa* genome, wherein the expression cassette comprises a polynucleotide being at least 90% identical to a nucleic acid sequence as shown in SEQ ID NO: 14, 16, 18, 20, 22, 32, 34, 36, 38, 42, or 44, or f) being the reverse complement of at least one of a) to e). Preferable the system for coordinated gene expression comprises a promoter providing for constitutive or inducible expression in said recombinant microorganism which is operably linked to the polynucleotide encoding the polypeptide having an amino acid sequence being at least 80% identical to SEQ ID NO: 25. Preferably, the system for coordinated gene expression is used in *Paecilomyces divaricatus* or *Byssochlamys verrucosa*. Other parts of the invention comprise vectors and recombinant microorganisms comprising at least one of the promoters, expression cassettes comprising such promoters and/or at least one of the systems of coordinated gene expression being described above or their variants as described herein. Further parts of the invention comprise methods for the production of cornexistin or hydroxycornexistin and methods to enhance the production of cornexistin or hydroxycornexistin comprising the vectors, expression cassettes and/or systems for coordinated gene expression as described above and/or comprising recombinant microorganisms comprising the vectors, expression cassettes and/or systems for coordinated gene expression as described above.

BRIEF DESCRIPTION OF THE DRAWINGS

FIG. 2b shows a schematic drawing of a variant of the cornexistin and hydroxycornexistin gene cluster using the same symbols for the open reading frames as described for FIG. 1. This variant has a length of 48269 base pairs and has a deletion of genes 1_9399, 2_9399, and 23_9399. The presence of genes 5_9399 and 6_9399 is optional. The depicted cluster does also represent cluster variants which differ in total sequence length, or order or orientation of the comprised open reading frames, due to the reasons described for the cluster variant depicted in FIG. 2a.

FIG. 3a shows a schematic drawing of a variant of the cornexistin and hydroxycornexistin gene cluster using the same symbols for the open reading frames as described for FIG. 1. This variant has a length of 42338 base pairs and has a deletion of genes 1_9399, 2_9399, 3_9399, 4_9399, 5_9399, 21_9399, 22_9399 and 23_9399. The presence of genes 6_9399 and 12_9399 is optional. The depicted cluster does also represent cluster variants which differ in total sequence length, or order or orientation of the comprised open reading frames, due to the reasons described for the cluster variant depicted in FIG. 2a.

FIG. 3b shows a schematic drawing of a variant of the cornexistin and hydroxycornexistin gene cluster using the same symbols for the open reading frames as described for FIG. 1. The variant has a length of 33634 base pairs and has a deletion of genes 1_9399, 2_9399, 3_9399, 4_9399, 5_9399, 6_9399, 7_9399, 21_9399, 22_9399 and 23_9399. The presence of gene 12_9399 is optional. The depicted cluster does also represent cluster variants which differ in total sequence length, or order or orientation of the comprised open reading frames, due to the reasons described for the cluster variant depicted in FIG. 2a.

FIG. 4a to FIG. 4d (together FIG. 4) represent consecutive parts of an amino acid sequence alignment of the polypeptide encoded by gene 1_9399 (SEQ ID NO: 3) and variants thereof (SEQ ID NO: 3, 59, 60, 61, 62 and 63). The amino acids are represented according to the standard single letter amino acid code. The names of the different sequences comprise the SEQ ID NOs under which these sequences are listed in the sequence listing.

Figure 5A:
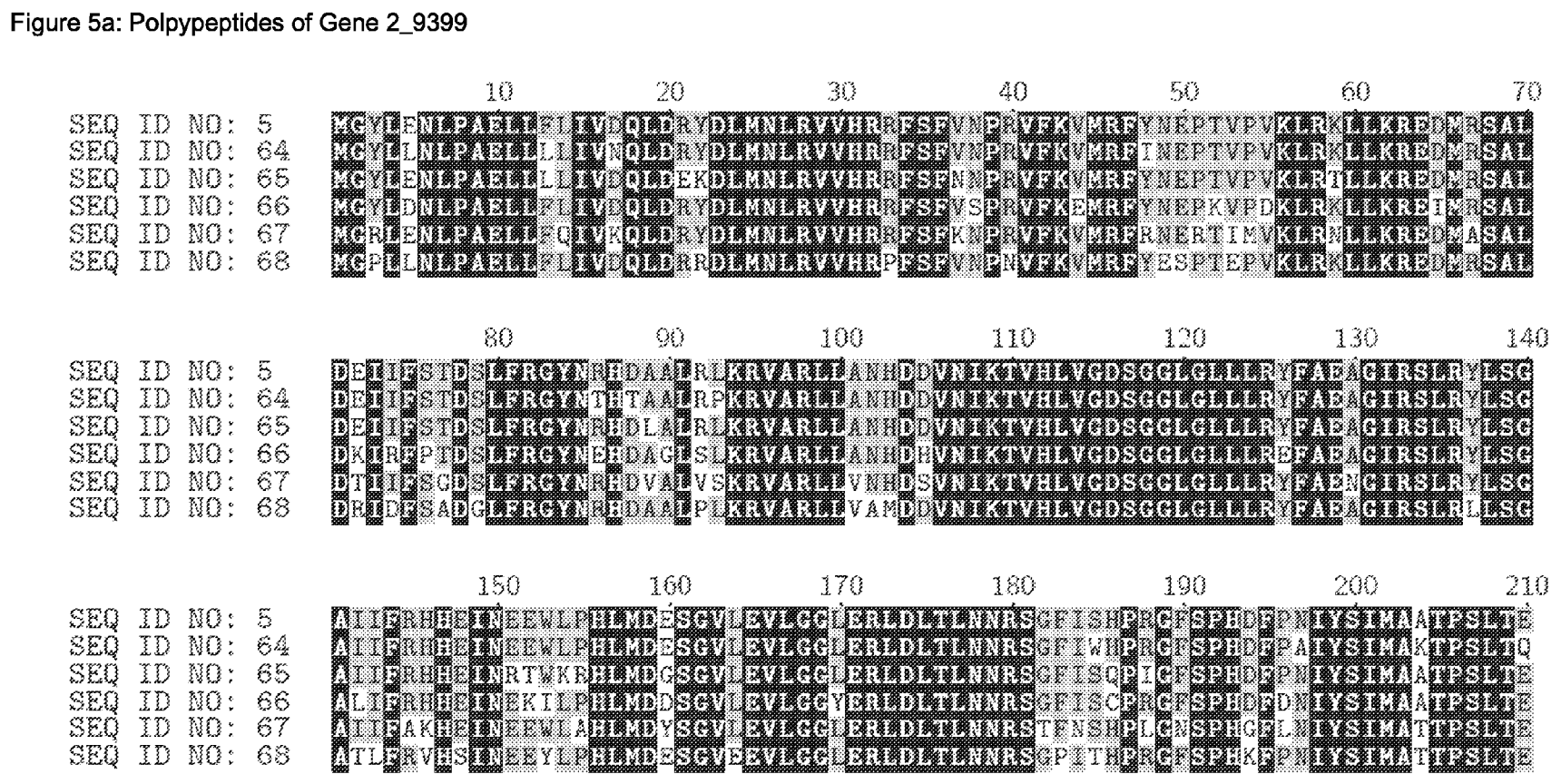

FIG. 5a to FIG. 5b (together FIG. 5) represent consecutive parts of an amino acid sequence alignment of the polypeptide encoded by gene 2_9399 (SEQ ID NO: 5) and variants thereof (SEQ ID NO: 5, 64, 65, 66, 67 and 68). The amino acids are represented and named as decribed for FIG. 4 (FIGS. 4a to 4d).

Figure 6:
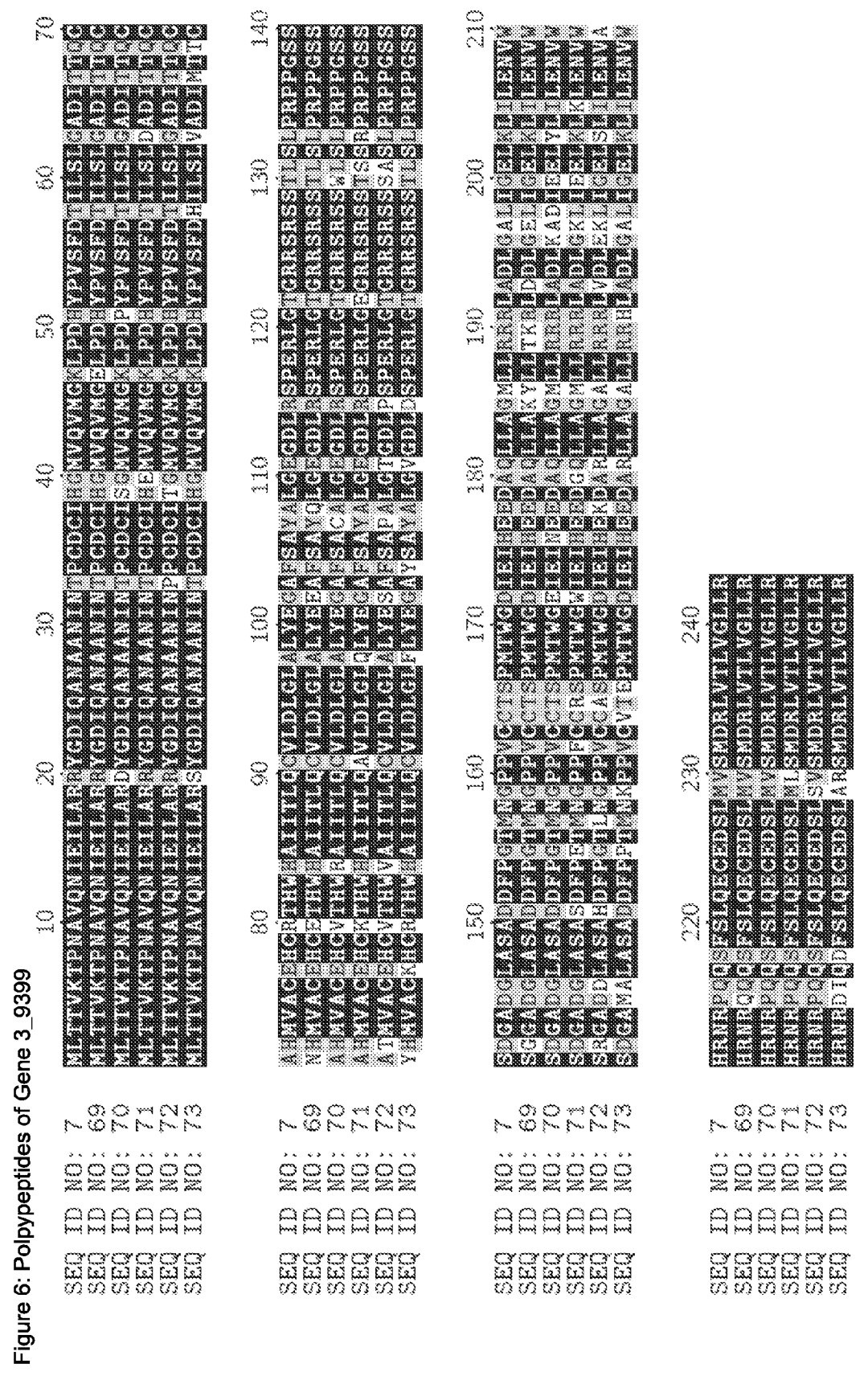

FIG. 6 represents an amino acid sequence alignment of the polypeptide encoded by gene 3_9399 (SEQ ID NO: 7) and variants thereof (SEQ ID NO: 7, 69, 70, 71, 72 and 73). The amino acids are represented and named as decribed for FIG. 4 (FIGS. 4a to 4d).

FIG. 7a to FIG. 7b (together FIG. 7) represent consecutive parts of an amino acid sequence alignment of the polypeptide encoded by gene 4_9399 (SEQ ID NO: 9) and variants thereof (SEQ ID NO: 9, 74, 75, 76, 77 and 78). The amino acids are represented and named as decribed for FIG. 4 (FIGS. 4a to 4d).

FIG. 8a to FIG. 8c (together FIG. 8) represent consecutive parts of an amino acid sequence alignment of the polypeptide encoded by gene 6_9399 (SEQ ID NO: 13) and variants thereof (SEQ ID NO: 13, 79, 80, 81, 82 and 83). The amino acids are represented and named as decribed for FIG. 4 (FIGS. 4a to 4d).

FIG. 9a to FIG. 9d (together FIG. 9) represent consecutive parts of an amino acid sequence alignment of the polypeptide encoded by gene 7_9399 (SEQ ID NO: 15) and variants thereof (SEQ ID NO: 15, 84, 85, 86, 87, 88, 89, 90, 91, 92, 93 and 94). The amino acids are represented and named as decribed for FIG. 4 (FIGS. 4a to 4d).

FIG. 10a to FIG. 10b (together FIG. 10) represent consecutive parts of an amino acid sequence alignment of the polypeptide encoded by gene 8_9399 (SEQ ID NO: 17) and variants thereof (SEQ ID NO: 17, 95, 96, 97, 98 and 99). The amino acids are represented and named as decribed for FIG. 4 (FIGS. 4a to 4d).

FIG. 11a to FIG. 11b (together FIG. 11) represent consecutive parts of an amino acid sequence alignment of the polypeptide encoded by gene 9_9399 (SEQ ID NO: 19) and variants thereof (SEQ ID NO: 19, 100, 101, 102, 103, 104, 105, 106, 107, 108, 109 and 110). The amino acids are represented and named as decribed for FIG. 4 (FIGS. 4a to 4d).

FIG. 12a to FIG. 12b (together FIG. 12) represent consecutive parts of an amino acid sequence alignment of the polypeptide encoded by gene 10_9399 (SEQ ID NO: 21) and variants thereof (SEQ ID NO: 21, 111, 112, 113, 114 and 115). The amino acids are represented and named as decribed for FIG. 4 (FIGS. 4a to 4d).

FIG. 13a to FIG. 13e (together FIG. 13) represent consecutive parts of an amino acid sequence alignment of the polypeptide encoded by gene 11_9399 (SEQ ID NO: 23) and variants thereof (SEQ ID NO: 23, 116, 117, 118, 119, 120, 121, 122, 123, 124, 125 and 126). The amino acids are represented and named as decribed for FIG. 4 (FIGS. 4a to 4d).

FIG. 14a to FIG. 14b (together FIG. 14) represent consecutive parts of an amino acid sequence alignment of the polypeptide encoded by gene 12_9399 (SEQ ID NO: 25) and variants thereof (SEQ ID NO: 25, 127, 128, 129, 130 and 131). The amino acids are represented and named as decribed for FIG. 4 (FIGS. 4a to 4d). Arrows mark conserved cysteines, which form part of the $Zn_2C_6$ zinc finger DNA binding domain of the aligned polypeptides and which are necessary for complexation of the Zinc ions and the correct folding of the DNA binding domain.

FIG. 15a to FIG. 15b (together FIG. 15) represent consecutive parts of an amino acid sequence alignment of the polypeptide encoded by gene 13_9399 (SEQ ID NO: 27) and variants thereof (SEQ ID NO: 27, 132, 133, 134, 135 and 136). The amino acids are represented and named as decribed for FIG. 4 (FIGS. 4a to 4d).

FIG. 16a to FIG. 16d (together FIG. 16) represent consecutive parts of an amino acid sequence alignment of the polypeptide encoded by gene 14_9399 (SEQ ID NO: 29) and variants thereof (SEQ ID NO: 29, 137, 138, 139, 140, 141, 142, 143, 144, 145, 146 and 147). The amino acids are represented and named as decribed for FIG. 4 (FIGS. 4a to 4d).

FIG. 17a to FIG. 17b (together FIG. 17) represent consecutive parts of an amino acid sequence alignment of the polypeptide encoded by gene 15_9399 (SEQ ID NO: 31) and variants thereof (SEQ ID NO: 31, 148, 149, 150, 151 and 152). The amino acids are represented and named as decribed for FIG. 4 (FIGS. 4a to 4d).

FIG. 18a to FIG. 18d (together FIG. 18) represent consecutive parts of an amino acid sequence alignment of the polypeptide encoded by gene 16_9399 (SEQ ID NO: 33) and variants thereof (SEQ ID NO: 33, 153, 154, 155, 156, 157, 158, 159, 160, 161, 162 and 163). The amino acids are represented and named as decribed for FIG. 4 (FIGS. 4a to 4d).

FIG. 19a to FIG. 19b (together FIG. 19) represent consecutive parts of an amino acid sequence alignment of the polypeptide encoded by gene 17_9399 (SEQ ID NO: 35) and variants thereof (SEQ ID NO: 35, 164, 165, 166, 167, 168, 169, 170, 171, 172, 173 and 174). The amino acids are represented and named as decribed for FIG. 4 (FIGS. 4a to 4d).

FIG. 20a to FIG. 20d (together FIG. 20) represent consecutive parts of an amino acid sequence alignment of the polypeptide encoded by gene 18_9399 (SEQ ID NO: 37) and variants thereof (SEQ ID NO: 37, 175, 176, 177, 178, 179, 180, 181, 182, 183, 184 and 185). The amino acids are represented and named as decribed for FIG. 4 (FIGS. 4a to 4d).

Figure 21:
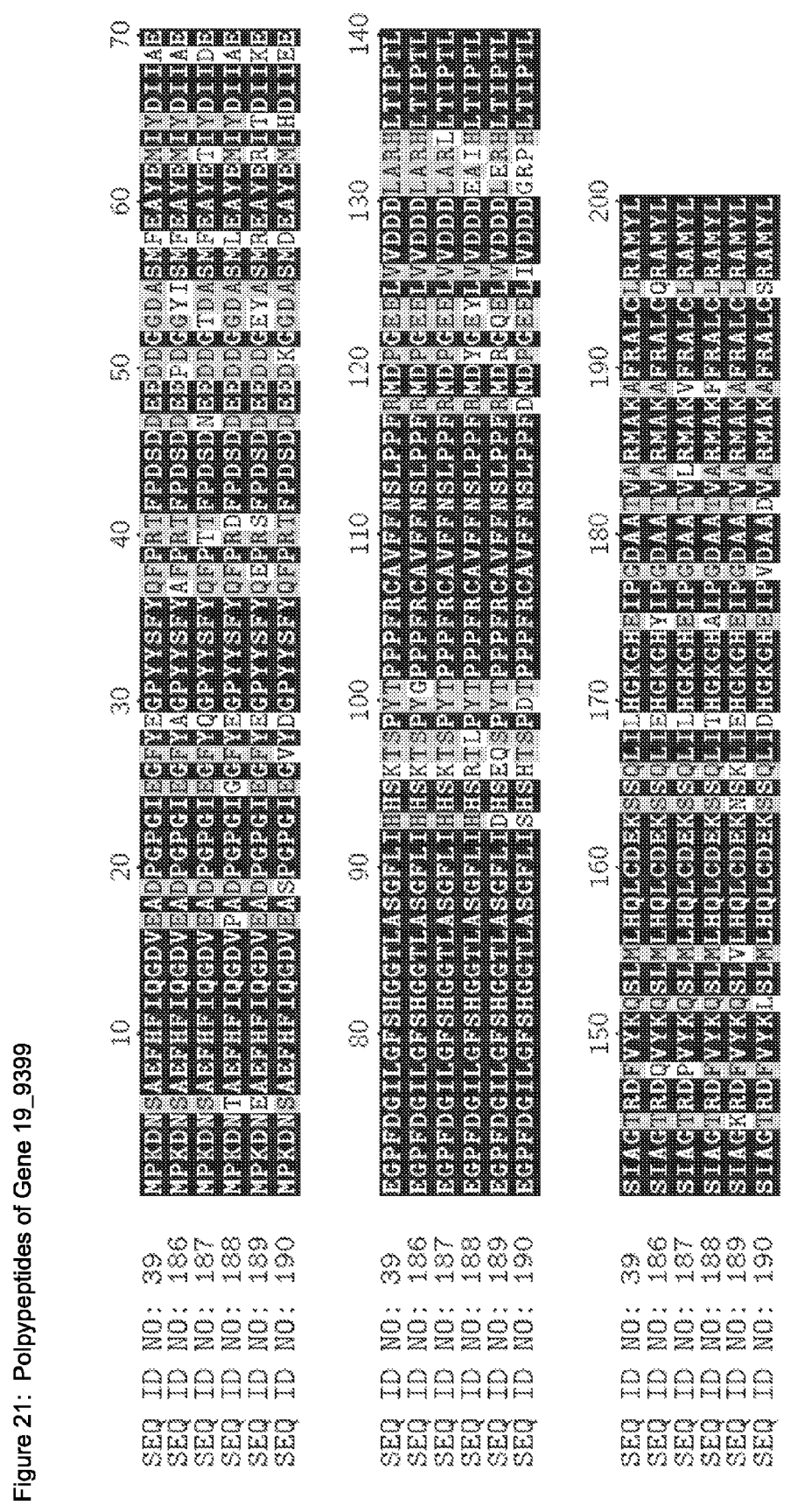

FIG. 21 represents an amino acid sequence alignment of the polypeptide encoded by gene 19_9399 (SEQ ID NO: 39) and variants thereof (SEQ ID NO: 39, 186, 187, 188, 189 and 190). The amino acids are represented and named as decribed for FIG. 4 (FIGS. 4a to 4d).

FIG. 22a to FIG. 22r (together FIG. 22) represent consecutive parts of an amino acid sequence alignment of the polypeptide encoded by gene 20_9399 (SEQ ID NO: 41) and variants thereof (SEQ ID NO: 41, 191, 192, 193, 194, 195, 196, 197, 198, 199, 200 and 201). The amino acids are represented and named as decribed for FIG. 4 (FIGS. 4a to 4d).

Figure 23:
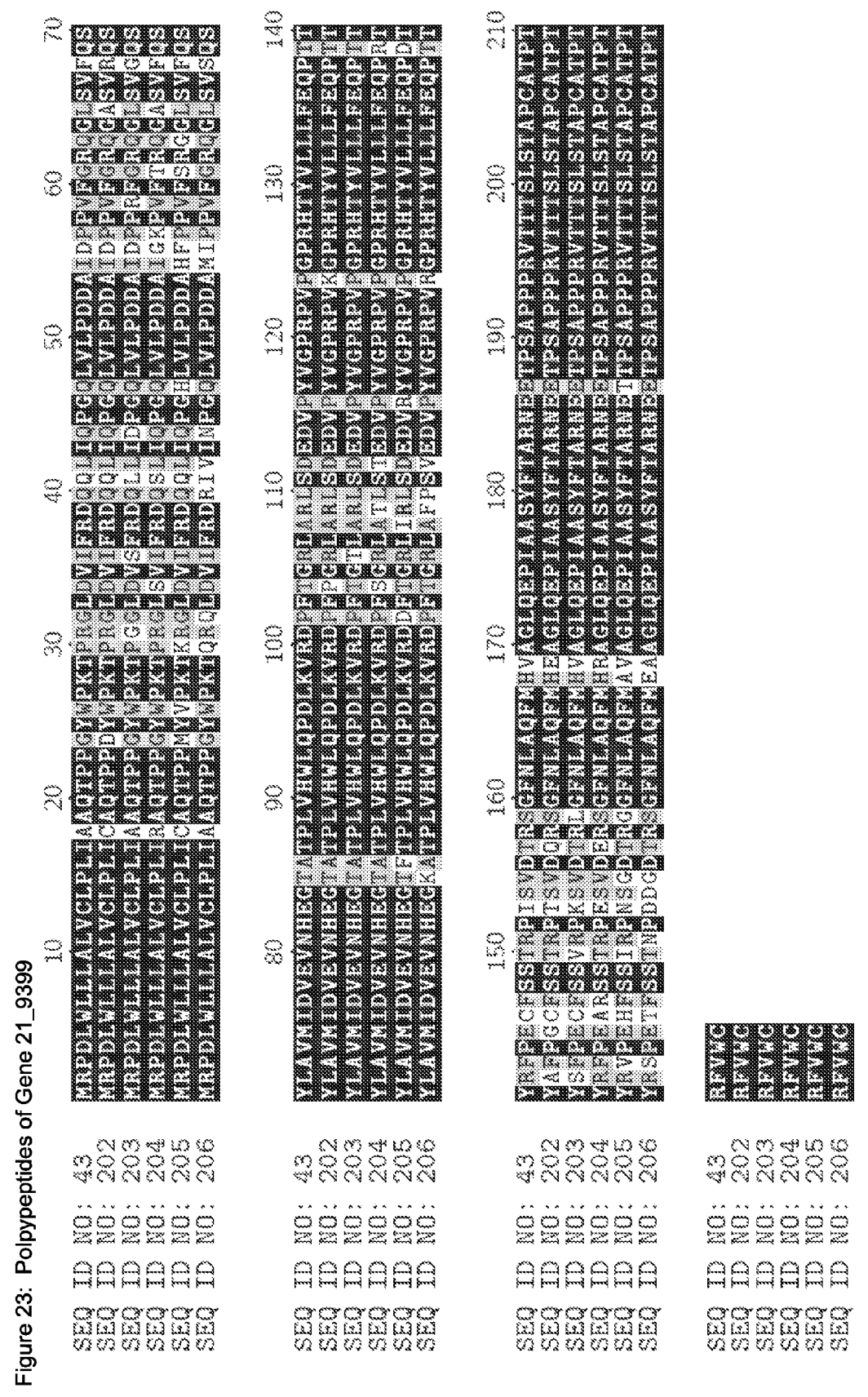

FIG. 23 represents an amino acid sequence alignment of the polypeptide encoded by gene 21_9399 (SEQ ID NO: 43) and variants thereof (SEQ ID NO: 43, 202, 203, 204, 205 and 206). The amino acids are represented and named as decribed for FIG. 4 (FIGS. 4a to 4d).

FIG. 24 represents an amino acid sequence alignment of the polypeptide encoded by gene 22_9399 (SEQ ID NO: 45) and variants thereof (SEQ ID NO: 45, 207, 208, 209, 210 and 211). The amino acids are represented and named as decribed for FIG. 4 (FIGS. 4a to 4d).

FIG. 25a to FIG. 25b (together FIG. 25) represent consecutive parts of an amino acid sequence alignment of the polypeptide encoded by gene 23_9399 (SEQ ID NO: 47) and variants thereof (SEQ ID NO: 47, 212, 213, 214, 215 and 216). The amino acids are represented and named as decribed for FIG. 4 (FIGS. 4a to 4d).

FIG. 26 depicts a time course of cornexistin production as described in Example 16.

GENENERAL DEFINITIONS

Figure 1:
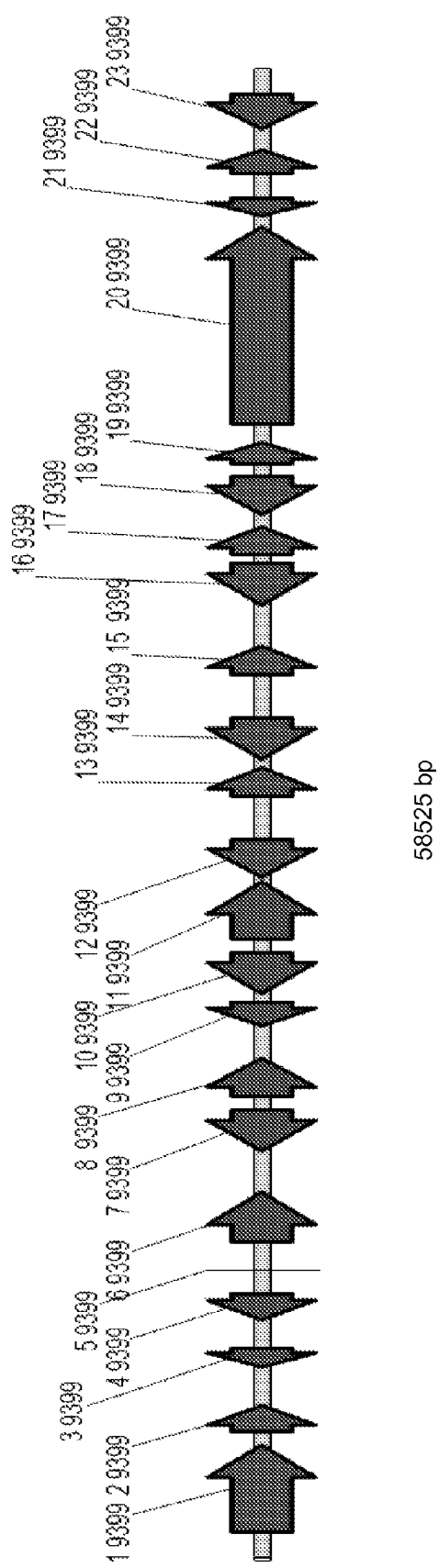
FIG. 1 shows a schematic drawing of the cornexistin and hydroxycornexistin gene cluster. Arrows represent the order and orientation of the coding regions for the genes 1_9399, 2_9300, 3_9399, up to gene 23_9399, which are also described in Table 2. The total length of the gene cluster is about 58525 base pairs.

The term "cornexistin" means a compound of Formula (I)

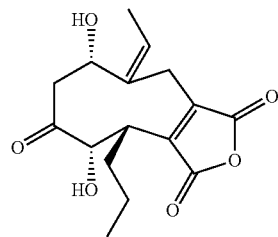

Formula (I)

The term " dibasic acid of cornexistin" means a compound of Formula (II) as well as salts of this compound, in particular agriculturally acceptable salts of a compound of Formula (II).

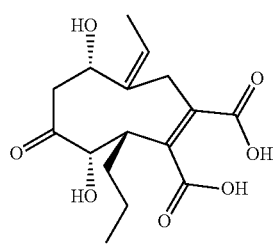

Formula (II)

The term " hydroxycornexistin" means a compound of Formula (III).

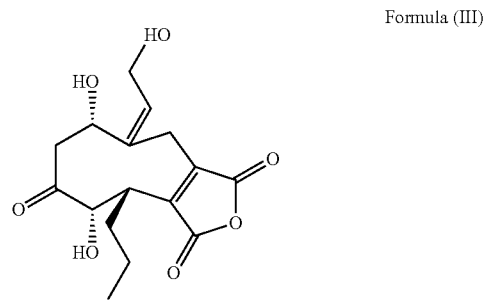 [SMILES: CCC[C@H]1C2=C(C/C(=C/CO)[C@@H](O)CC(=O)[C@H]1O)C(=O)OC2=O]

Formula (III)

The term " dibasic acid of hydroxycornexistin" means a compound of Formula (IV) as well as salts of this compound, in particular agriculturally acceptable salts of a compound of Formula (IV).

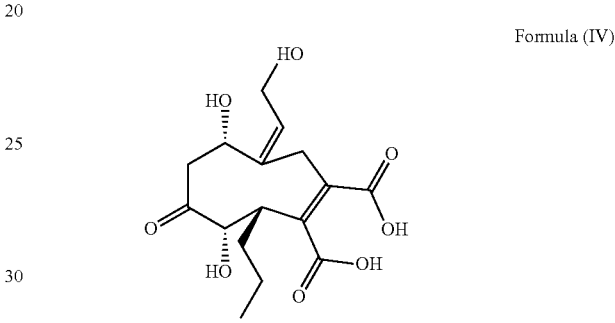

Formula (IV)

The compounds of Formulas I to IV as described herein are capable of forming geometrical isomers, for example E/Z isomers. They possess also several centers of chirality and, as a consequence, van be present as enantiomers or diastereomers. The compounds of Formulas II and IV are capable to form salts. Accordingly, the terms "cornexistin" "dibasic acid of cornexistin", "hydroxycornexistin" and "dibasic acid of hydroxycornexistin", in a broad sense, will also encompass the isomers and mixtures thereof as well as the pure enantiomers and diastereomers and their mixtures, as well as the salts of compounds of the Formula I to IV, preferably agriculturally acceptable salts of compounds of the Formula I to IV, more preferred agriculturally acceptable salts of compounds of the Formula II and IV.

In a strict interpretation of the terms "cornexistin" "dibasic acid of cornexistin", "hydroxycornexistin" and "dibasic acid of hydroxycornexistin" these terms will mean compounds as described by the respective Formula I to IV and their agriculturally acceptable salts The term "agriculturally acceptable salts" is used herein to mean in general, the salts of those cations and the acid addition salts of those acids whose cations and anions, respectively, have no adverse effect on the herbicidal activity of the dibasic acid of cornexistin, the dibasic acid of hydroxycornexistin and preferably have no adverse effect on the herbicidal activity of the dibasic acid of cornexistin and the dibasic acid of hydroxycornexistin.

Preferred cations are the ions of the alkali metals, preferably of lithium, sodium and potassium, of the alkaline earth metals, preferably of calcium and magnesium, and of the transition metals, preferably of manganese, copper, zinc and iron, further ammonium and substituted ammonium in which one to four hydrogen atoms are replaced by C1-C4-alkyl, hydroxy-C1-C4-alkyl, C1-C4-alkoxy-C1-C4-alkyl, hydroxy-C1-C4-alkoxy-C1-C4-alkyl, phenyl or benzyl, preferably ammonium, methylammonium, isopropylammonium, dimethylammonium, diisopropylammonium, trimethylammonium, heptylammonium, dodecylammonium, tetradecylammonium, tetramethylammonium, tetraethylammonium, tetrabutylammonium, 2 hydroxyethylammonium (olamine salt), 2-(2-hydroxyeth-1-oxy)eth-1-ylammonium (diglycolamine salt), di(2-hydroxyeth-1-yl)-ammonium (diolamine salt), tris(2-hydroxyethyl) ammonium (trolamine salt), tris(2-hydroxypropyl) ammonium, benzyltrimethylammonium, benzyltriethylammonium, N,N,N-trimethylethanolammonium (choline salt), furthermore phosphonium ions, sulfonium ions, preferably tri(C1-C4-alkyl)sulfonium, such as trimethylsulfonium, and sulfoxonium ions, preferably tri (C1-C4-alkyl)sulfoxonium, and finally the salts of polybasic amines such as N,N-bis-(3-aminopropyl)methylamine and diethylenetriamine.

Anions of useful acid addition salts are primarily chloride, bromide, fluoride, iodide, hydrogensulfate, methylsulfate, sulfate, dihydrogenphosphate, hydrogen phosphate, nitrate, bicarbonate, carbonate, hexafluorosilicate, hexafluorophosphate, benzoate and also the anions of C1-C4-alkanoic acids, preferably formate, acetate, propionate and butyrate.

The term "about" is used herein to mean approximately, roughly, around, or in the region of. When the term "about" is used in conjunction with a numerical range, it modifies that range by extending the boundaries above and below the numerical values-set forth. In general, the term "about" is used herein to modify a numerical value above and below the stated value by a variance of 20 percent up or down (higher or lower), preferably 15 percent, more preferably 10 percent and most preferably 5 percent.

The term "genome" or "genomic DNA" is referring to the heritable genetic information of a host organism. Said genomic DNA comprises the entire genetic material of a cell or an organism, including the DNA of the nucleus (chromosomal DNA), extrachromosomal DNA, and organellar DNA (e.g. of mitochondria). Preferably, the terms genome or genomic DNA is referring to the chromosomal DNA of the nucleus.

The term "chromosomal DNA" or "chromosomal DNA sequence" is to be understood as the genomic DNA of the cellular nucleus independent from the cell cycle status. Chromosomal DNA might therefore be organized in chromosomes or chromatids, they might be condensed or uncoiled. An insertion into the chromosomal DNA can be demonstrated and analyzed by various methods known in the art like e.g., polymerase chain reaction (PCR) analysis, Southern blot analysis, fluorescence in situ hybridization (FISH), in situ PCR and next generation sequencing (NGS).

The term "promoter" refers to a polynucleotide which directs the transcription of a structural gene to produce mRNA. Typically, a promoter is located in the 5' region of a gene, proximal to the start codon of a structural gene. If a promoter is an inducible promoter, then the rate of transcription increases in response to an inducing agent. In contrast, the rate of transcription is not regulated by an inducing agent, if the promoter is a constitutive promoter.

The term "enhancer" refers to a polynucleotide. An enhancer can increase the efficiency with which a particular gene is transcribed into mRNA irrespective of the distance or orientation of the enhancer relative to the start site of transcription. Usually an enhancer is located close to a promoter, a 5'-untranslated sequence or in an intron.

A polynucleotide is "heterologous to" an organism or a second polynucleotide if it originates from a foreign species, or, if from the same species, is modified from its original form. For example, a promoter operably linked to a heterologous coding sequence refers to a coding sequence from a species different from that from which the promoter was derived, or, if from the same species, a coding sequence which is not naturally associated with the promoter (e. g. a genetically engineered coding sequence or an allele from a different ecotype or variety).

"Transgene", "transgenic" or "recombinant" refers to a polynucleotide manipulated by man or a copy or complement of a polynucleotide manipulated by man. For instance, a transgenic expression cassette comprising a promoter operably linked to a second polynucleotide may include a promoter that is heterologous to the second polynucleotide as the result of manipulation by man (e.g., by methods described in Sambrook et al., Molecular Cloning-A Laboratory Manual, Cold Spring Harbor Laboratory, Cold Spring Harbor, N.Y., (1989) or Current Protocols in Molecular Biology Volumes 1-3, John Wiley & Sons, Inc. (1994-1998)) of an isolated nucleic acid comprising the expression cassette. In another example, a recombinant expression cassette may comprise polynucleotides combined in such a way that the polynucleotides are extremely unlikely to be found in nature. For instance, restriction sites or plasmid vector sequences manipulated by man may flank or separate the promoter from the second polynucleotide. One of skill will recognize that polynucleotides can be manipulated in many ways and are not limited to the examples above.

In case the term "recombinant" is used to specify an organism or cell, e.g. a microorganism, it is used to express that the organism or cell comprises at least one "transgene", "transgenic" or "recombinant" polynucleotide, which is usually specified later on.

A polynucleotide "exogenous to" an individual organism is a polynucleotide which is introduced into the organism by any means other than by a sexual cross.

The terms "operable linkage" or "operably linked" are generally understood as meaning an arrangement in which a genetic control sequence, e.g. a promoter, enhancer or terminator, is capable of exerting its function with regard to a polynucletide being operably linked to it, for example a polynucleotide encoding a polypeptide. Function, in this context, may mean for example control of the expression, i.e. transcription and/or translation, of the nucleic acid sequence. Control, in this context, encompasses for example initiating, increasing, governing or suppressing the expression, i.e. transcription and, if appropriate, translation. Controlling, in turn, may be, for example, tissue- and/or time-specific. It may also be inducible, for example by certain chemicals, stress, pathogens and the like. Preferably, operable linkage is understood as meaning for example the sequential arrangement of a promoter, of the nucleic acid sequence to be expressed and, if appropriate, further regulatory elements such as, for example, a terminator, in such a way that each of the regulatory elements can fulfill its function when the nucleic acid sequence is expressed. An operably linkage does not necessarily require a direct linkage in the chemical sense. Genetic control sequences such as, for example, enhancer sequences are also capable of exerting their function on the target sequence from positions located at a distance to the polynucleotide, which is operably linked. Preferred arrangements are those in which the nucleic acid sequence to be expressed is positioned after a sequence acting as promoter so that the two sequences are linked covalently to one another. The distance between the promoter and the amino acid sequence encoding polynucleotide in an expression cassette, is preferably less than 200 base pairs, especially preferably less than 100 base pairs, very especially preferably less than 50 base pairs. The skilled worker is familiar with a variety of ways in order to obtain such an expression cassette. However, an expression cassette may also be constructed in such a way that the nucleic acid sequence to be expressed is brought under the control of an endogenous genetic control element, for example an endogenous promoter, for example by means of homologous recombination or else by random insertion. Such constructs are likewise understood as being expression cassettes for the purposes of the invention.

The term "expression cassette" means those construct in which the nucleic acid sequence encoding an amino acid sequence to be expressed is linked operably to at least one genetic control element which enables or regulates its expression (i.e. transcription and/or translation). The expression may be, for example, stable or transient, constitutive or inducible.

The terms "express," "expressing," "expressed" and "expression" refer to expression of a gene product (e.g., a biosynthetic enzyme of a gene of a pathway or reaction defined and described in this application) at a level that the resulting enzyme activity of this protein encoded for, or the pathway or reaction that it refers to allows metabolic flux through this pathway or reaction in the organism in which this gene/pathway is expressed in. The expression can be done by genetic alteration of the microorganism that is used as a starting organism. In some embodiments, a microorganism can be genetically altered (e.g., genetically engineered) to express a gene product at an increased level relative to that produced by the starting microorganism or in a comparable microorganism which has not been altered. Genetic alteration includes, but is not limited to, altering or modifying regulatory sequences or sites associated with expression of a particular gene (e.g. by adding strong promoters, inducible promoters or multiple promoters or by removing regulatory sequences such that expression is constitutive), modifying the chromosomal location of a particular gene, altering nucleic acid sequences adjacent to a particular gene such as a ribosome binding site or transcription terminator, increasing the copy number of a particular gene, modifying proteins (e.g., regulatory proteins, suppressors, enhancers, transcriptional activators and the like) involved in transcription of a particular gene and/or translation of a particular gene product, or any other conventional means of deregulating expression of a particular gene using routine in the art (including but not limited to use of antisense nucleic acid molecules, for example, to block expression of repressor proteins).

In some embodiments, a microorganism can be physically or environmentally altered to express a gene product at an increased or lower level relative to level of expression of the gene product unaltered microorganism. For example, a microorganism can be treated with, or cultured in the presence of an agent known, or suspected to increase transcription of a particular gene and/or translation of a particular gene product such that transcription and/or translation are enhanced or increased. Alternatively, a microorganism can be cultured at a temperature selected to increase transcription of a particular gene and/or translation of a particular gene product such that transcription and/or translation are enhanced or increased.

The terms "deregulate," "deregulated" and "deregulation" refer to alteration or modification of at least one gene in a microorganism, wherein the alteration or modification results in increasing efficiency of production of a given compound in the microorganism relative to production in absence of the alteration or modification. In some embodiments, a gene that is altered or modified encodes an enzyme in a biosynthetic pathway, or a transport protein, such that the level or activity of the biosynthetic enzyme in the microorganism is altered or modified, or that the transport specificity or efficiency is altered or modified. In some embodiments, at least one gene that encodes an enzyme in a biosynthetic pathway, i.e. a polypeptide bringing about a specific activity in the biosynthetic pathway, is altered or modified such that the level or activity of the enzyme is enhanced or increased relative to the level in presence of the unaltered or wild type gene.

Deregulation also includes altering the coding region of one or more genes to yield, for example, an enzyme that is feedback resistant or has a higher or lower specific activity. Also, deregulation further encompasses genetic alteration of genes encoding transcriptional factors (e.g., activators, repressors) which regulate expression of genes coding for enzymes or transport proteins. The terms " deregulate," " deregulated" and " deregulation" can further be specified in regard to the kind of deregulation present.

In case the particular activity, is altered or modified such that the level or activity of the enzyme is enhanced or increased relative to the level in presence of the unaltered or wild type gene, the term "up-regulated" is used. In case particular activity, is altered or modified such that the level or activity of the enzyme is lowered or decreased relative to the level in presence of the unaltered or wild type gene, the term "down-regulated" is used.

The term "deregulated" includes expression of a gene product at a level lower or higher than that expressed prior to manipulation of the microorganism or in a comparable microorganism which has not been manipulated. In one embodiment, the microorganism can be genetically manipulated (e.g., genetically engineered) to express a level of gene product at a lesser or higher level than that expressed prior to manipulation of the microorganism or in a comparable microorganism which has not been manipulated. Genetic manipulation can include, but is not limited to, altering or modifying regulatory sequences or sites associated with expression of a particular gene (e.g., by removing strong promoters, inducible promoters or multiple promoters), modifying the chromosomal location of a particular gene, altering nucleic acid sequences adjacent to a particular gene such as a ribosome binding site or transcription terminator, decreasing the copy number of a particular gene, modifying proteins (e.g., regulatory proteins, suppressors, enhancers, transcriptional activators and the like) involved in transcription of a particular gene and/or translation of a particular gene product, or any other conventional means of deregulating expression of a particular gene routine in the art (including but not limited to use of antisense nucleic acid molecules, or other methods to knock-out or block expression of the target protein).

The term "deregulated gene activity" also means that a gene activity is introduced into a microorganism where the respective gene activity, has not been observed before, e.g. by introducing a recombinant gene, e.g. a heterologous gene, in one or more copies into the microorganism preferably by means of genetic engineering.

The phrase "deregulated pathway or reaction" refers to a biosynthetic pathway or reaction in which at least one gene that encodes an enzyme in a biosynthetic pathway or reaction is altered or modified such that the level or activity of at least one biosynthetic enzyme is altered or modified. The phrase "deregulated pathway" includes a biosynthetic pathway in which more than one gene has been altered or modified, thereby altering level and/or activity of the corresponding gene products/enzymes. In some cases the ability to "deregulate" a pathway (e.g., to simultaneously deregulate more than one gene in a given biosynthetic pathway) in a microorganism arises from the particular phenomenon of microorganisms in which more than one enzyme (e.g., two or three biosynthetic enzymes) are encoded by genes occurring adjacent to one another on a contiguous piece of genetic material termed a "cluster" or "gene cluster" In other cases, in order to deregulate a pathway, a number of genes must be deregulated in a series of sequential engineering steps.

To express the deregulated genes according to the invention, the DNA sequence encoding the polypeptide must be operably linked to regulatory sequences that control transcriptional expression in an expression vector and then, introduced into either microorganism. In addition to transcriptional regulatory sequences, such as promoters and enhancers, expression vectors can include translational regulatory sequences and a marker gene which is suitable for selection of cells that carry the expression vector.

The terms "overexpress", "overexpressing", "overexpressed" and "overexpression" refer to expression of a gene product, in particular to enhancing the expression of a gene product at a level greater than that present prior to a genetic alteration of the starting microorganism. In some embodiments, a microorganism can be genetically altered (e.g., genetically engineered) to express a gene product at an increased level relative to that produced by the starting microorganism. Genetic alteration includes, but is not limited to, altering or modifying regulatory sequences or sites associated with expression of a particular gene (e.g., by adding strong promoters, inducible promoters or multiple promoters or by removing regulatory sequences such that expression is constitutive), modifying the chromosomal location of a particular gene, altering nucleic acid sequences adjacent to a particular gene such as a ribosome binding site or transcription terminator, increasing the copy number of a particular gene, modifying proteins (e.g., regulatory proteins, suppressors, enhancers, transcriptional activators and the like) involved in transcription of a particular gene and/or translation of a particular gene product, or any other conventional means of deregulating expression of a particular gene using routine in the art (including but not limited to use of antisense nucleic acid molecules, for example, to block expression of repressor proteins). Another way to overexpress a gene product is to enhance the stability of the gene product to increase its life time.

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002) & The Pfam protein families database: R. D. Finn, J. Mistry, J. Tate, P. Coggill, A. Heger, J. E. Pollington, O. L. Gavin, P. Gunesekaran, G. Ceric, K. Forslund, L. Holm, E. L. Sonnhammer, S. R. Eddy, A. Bateman Nucleic Acids Research (2010) Database Issue 38:D211-222). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788(2003)). Domains or motifs may also be identified using routine techniques, such as by sequence alignment.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimize alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith TF, Waterman MS (1981) J. Mol. Biol 147(1);195-7).

Typically, this involves a first BLAST involving BLASTing a query sequence against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived. The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

The term "sequence identity" between two nucleic acid sequences is understood as meaning the percent identity of the nucleic acid sequence over in each case the entire sequence length which is calculated by alignment with the aid of the program algorithm GAP (Wisconsin Package Version 10.0, University of Wisconsin, Genetics Computer Group (GCG), Madison, USA), setting the following parameters:

| | |
|---|---|
| Gap Weight: 12 | Length Weight: 4 |
| Average Match: 2,912 | Average Mismatch: −2,003 |

The term " sequence identity" between two amino acid sequences is understood as meaning the percent identity of the nucleic acid sequence over in each case the entire sequence length which is calculated by alignment with the aid of the program algorithm GAP (Wisconsin Package Version 10.0, University of Wisconsin, Genetics Computer Group (GCG), Madison, USA), setting the following parameters:

| | |
|---|---|
| Gap Weight: 8 | Length Weight: 2 |
| Average Match: 2,912 | Average Mismatch: −2,003 |

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The $T_m$ is the temperature under defined ionic strength and pH, at which 50% of the target sequence hybridises to a perfectly matched probe. The $T_m$, is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The $T_m$ may be calculated using the following equations, depending on the types of hybrids:

1) DNA-DNA hybrids (Meinkoth and Wahl, Anal. Biochem., 138: 267-284, 1984):

$$T_m=81.5°\ C.+16.6\times\log_{10}[Na^+]^a+0.41\times\%[G/C^b]-500\times[L^c]^{-1}-0.61\times\%\ \text{formamide}$$

2) DNA-RNA or RNA-RNA hybrids:

$$T_m=79.8°\ C.+18.5\ (\log_{10}[Na^+]^a)+0.58\ (\%\ G/C^b)+11.8\ (\%\ G/C^b)^2-820/L^c$$

3) oligo-DNA or oligo-RNAs hybrids:

For <20 nucleotides: $T_m=2\ (l_n)$

For 20-35 nucleotides: $T_m=22+1.46\ (l_n)$ $^a$ or for other monovalent cation, but only accurate in the 0.01-0.4 M range.
$^b$ only accurate for % GC in the 30% to 75% range.
$^c$L=length of duplex in base pairs.
$^d$ oligo, oligonucleotide; $l_n$,=effective length of primer=2×(no. of G/C)+(no. of A/T).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions. Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background.

Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions. For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5× Denhardt's reagent, 0.5-1.0% SDS, 100 µg/ml denatured, fragmented salmon sperm DNA, 0.5% sodium pyrophosphate. For the purposes of defining the level of stringency, reference can be made to Sambrook et al. (2001) Molecular Cloning: a laboratory manual, 3$^{rd}$ Edition, Cold Spring Harbor Laboratory Press, CSH, New York or to Current Protocols in Molecular Biology, John Wiley & Sons, N.Y. (1989 and yearly updates).

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag. 100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide and may range from 1 to 10 amino acids; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions |
|---------|---------------------------|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Reference herein to an "endogenous" gene not only refers to the gene in question as found in an organism in its natural form (i.e., without there being any human intervention), but also refers to that same gene (or a substantially homologous nucleic acid/gene) in an isolated form subsequently (re)introduced into a microorganism (a transgene). For example, a transgenic microorganism containing such a transgene may encounter a substantial reduction of the transgene expression and/or substantial reduction of expression of the endogenous gene. The isolated gene may be isolated from an organism or may be manmade, for example by chemical synthesis.

The terms "orthologues" and "paralogues" encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6:25).

The term "vector", preferably, encompasses phage, plasmid, fosmid, viral vectors as well as artificial chromosomes, such as bacterial or yeast artificial chromosomes. Moreover, the term also relates to targeting constructs which allow for random or site-directed integration of the targeting construct into genomic DNA. Such target constructs, preferably, comprise DNA of sufficient length for either homologous or heterologous recombination as described in detail below. The vector encompassing the polynucleotide of the present invention, preferably, further comprises selectable markers for propagation and/or selection in a recombinant microorganism. The vector may be incorporated into a recombinant microorganism by various techniques well known in the art. If introduced into a recombinant microorganism, the vector may reside in the cytoplasm or may be incorporated into the genome. In the latter case, it is to be understood that the vector may further comprise nucleic acid sequences which allow for homologous recombination or heterologous insertion. Vectors can be introduced into prokaryotic or eukaryotic cells via conventional transformation or transfection techniques. The terms "transformation" and "transfection", conjugation and transduction, as used in the present context, are intended to comprise a multiplicity of prior-art processes for introducing foreign nucleic acid (for example DNA) into a recombinant microorganism, including calcium phosphate, rubidium chloride or calcium chloride co-precipitation, DEAE-dextran-mediated transfection, lipofection, natural competence, carbon-based clusters, chemically mediated transfer, electroporation or particle bombardment. Methods for many species of microorganisms are readily available in the literature, for example, in Turgeon (2010) Molecular and cell biology methods for fungi, p 3-9, in Koushki, MM et al., (2011), AFRICAN JOURNAL OF BIOTECHNOLOGY Vol. 10 (41): p 7939-7948, in Coyle et al. (2010) Appl Environ Microbiol 76:3898-3903, in Current Protocols in Molecular Biology, Chapter 13. Eds Ausubel F.M. et al. Wiley & Sons, U.K., and in Genome Analysis: A Laboratory Manual, Cloning Systems. Volume 3. Edited by Birren B, Green E D, Klapholz S, Myers R M, Riethman H, Roskams J. New York: Cold Spring Harbor Laboratory Press; 1999: 297-565.

DETAILED DESCRIPTION OF PREFERRED EMBODIMENTS

In a first aspect, the present invention provides nucleic acid sequences which encodes a polypeptide being involved in the cornexistin and/or hydroxycornexistin synthesis As used herein, cornexistin and hydroxycornexistin synthesis encompasses all steps of the biosynthesis of cornexistin and/or hydroxycornexistin. Accordingly, a polypeptide which is involved in the synthesis of cornexistin and/or hydroxycornexistin may either convert a substrate into cornexistin or hydroxycornexistin or may produce any of the precursors which occur in the cornexistin and hydroxycornexistin biosynthesis. Preferably, the polypeptide encoded by the polynucleotide of the present invention shall be capable of increasing the amount of cornexistin and/or hydroxycornexistin or a precursor thereof upon expression in an organism, preferably a recombinant microorganism as specified elsewhere herein. Such an increase is, preferably, statistically significant when compared to a control organism which lacks expression of the polynucleotide of the present invention Preferably the control organism is of the same species and even more preferred belongs to the same strain that was used to construct the recombinant microorganism. Whether an increase is significant can be determined by statistical tests well known in the art including, e.g., Student's t-test. More preferably, the increase is an increase of the amount of cornexistin and/or hydroxycornexistin of at least 5%, at least 10%, at least 15%, at least 20% or at least 30% compared to said control. Suitable assays to identify and measure the amount of cornexistin and hydroxycornexistin are known by the person skilled in the art and are described for example in U.S. Pat. Nos. 4,897,104, 4,990,178, 5,424,278 and in the accompanying Examples.

One nucleic acid sequences provided by the invention is a gene cluster described by SEQ ID NO: 1, which comprises expression cassette for polypeptides being involved in cornexistin and/or hydroxycornexistin synthesis. A schematic representation of the gene cluster is provided by FIG. 1.

TABLE 2

Listing of genes and encoded polypeptides of the sequence of SEQ ID NO: 1:

| Gene Name (ORF) | Starting point in SEQ ID No 1 | Endpoint in SEQ ID No 1 | Seq ID NO: | Function | Corresponding protein Seq ID NO: |
|---|---|---|---|---|---|
| 1_9399 | 1001 | 4395 | 2 | AMP binding protein, phospopantheine binding protein | 3 |
| 2_9399 | 4937 | 5965 | 4 | protein | 5 |
| 3_9399 | 8236 | 7505 | 6 | protein | 7 |
| 4_9399 | 10368 | 9322 | 8 | Alcohol/keto oxido-reductase | 9 |
| 5_9399 | 11274 | 11354 | 10 | protein | 11 |
| 6_9399 | 12423 | 14345 | 12 | Transketolase | 13 |
| 7_9399 | 17599 | 15965 | 14 | Cytochrom P450 oxygenase | 15 |
| 8_9399 | 18123 | 19631 | 16 | Sugar transporter | 17 |
| 9_9399 | 21831 | 20880 | 18 | Lactone hydrolase protein | 19 |
| 10_9399 | 23763 | 22165 | 20 | Transporter protein | 21 |
| 11_9399 | 24308 | 26347 | 22 | protein | 23 |
| 12_9399 | 28222 | 26750 | 24 | Transcriptional regulator protein | 25 |

TABLE 2-continued Listing of genes and encoded polypeptides of the sequence of SEQ ID NO: 1:

| Gene Name (ORF) | Starting point in SEQ ID No 1 | Endpoint in SEQ ID No 1 | Seq ID NO: | Function | Corresponding protein Seq ID NO: |
|---|---|---|---|---|---|
| 13_9399 | 29894 | 31024 | 26 | Gluconolactonase protein | 27 |
| 14_9399 | 32996 | 31399 | 28 | Citrate synthase protein | 29 |
| 15_9399 | 35799 | 34706 | 30 | Dioxygenase protein | 31 |
| 16_9399 | 39097 | 37437 | 32 | Transporter protein | 33 |
| 17_9399 | 39414 | 40500 | 34 | Polyketide cyclase protein | 35 |
| 18_9399 | 42510 | 40981 | 36 | Methylcitrate dehydratase protein | 37 |
| 19_9399 | 42995 | 43808 | 38 | Thioesterase protein | 39 |
| 20_9399 | 44518 | 52300 | 40 | Polyketide synthase protein | 41 |
| 21_9399 | 53415 | 52707 | 42 | protein | 43 |
| 22_9399 | 54385 | 55295 | 44 | protein | 45 |
| 23_9399 | 57525 | 56158 | 46 | Phosphotransferase protein | 47 |

Table 2 provides a listing of the polypeptide (protein) encoding sequences of SEQ ID NO: 1, the respective ORF names, the number of the nucleotides in SEQ ID NO: 1, which are starting and endponts of the polypeptide encoding sequences, the likely function of the encoded polypeptides and the respective SEQ ID NOs: of the polynucleotide and amino acid sequences in the sequence listings.

The provided polynucleotides recombinant polynucleotides can either be isolated from their natural genomic environment, modified after their isolation or produced artificially from pure sequence information. A natural source of polynucleotides of the invention are cornexistin or hydroycornexistin producing fungi and related species. Such fungi can, for example, be found in the group consisting of the genus Paecilomyces, the genus Byssochlamys, the genus Thermoascus and the genus Monascus for example the species Byssochlamys verrucosa, Byssochlamys nivea, Paecilomyces divaricatus, Paecilomyces variotii, Thermoascus crustaceus, Thermoascus thermophilus and Thermoascus aurantiacus. Of particular interest are fungi of the species: Paecilomyces divaricatus and Byssochlamys verrucosa. Strains of these species are deposited, for example, at the CBS Fungal Biodiversity Centre as: Byssochlamys verrucosa CBS 605.74 isolated in Australia, Paecilomyces divaricatus CBS 284.48 isolated in the USA and Paecilomyces divaricatus CBS 110429 isolated in Mexico. A most preferred strain of Paecilomyces variotii has been deposited under Ministry of International Trade and Industry Japan deposit number FERM BP-1351 and deposited at the American Type Culture Collection under accession number ATTC 74268, both being derived from Paecilomyces variotii Bainier SANK 21086, having been isolated from deer faeces collected in Canada. Further information for the selection of suitable organisms can, for example, be found in Mutsuo Nakajima et al.; CORNEXISTIN: A NEW FUNGAL METABOLITE WITH HERBICIDAL ACTIVITY; THE JOURNAL OF ANTIBIOTICS, VOL. 44 NO. 10, 1991: page 1065-1072, in U.S. Pat. Nos. 4,897,104, 4,990,178, 5,424,278 and in R.A. Samson et al. "Polyphasic taxonomy of the heat resistant ascomycete genus Byssochlamys and its Paecilomyces anamorphs" Persoonia 22, 2009: pages 14-27.

The sequence information of polynucleotides isolated from the natural sources described above can be used to isolate homologous polynucleotides and allelic or splice variants of the genes, promoter and terminator sequences comprised by SEQ ID NO: 1, as well as homologous polynucleotides and allelic variants of SEQ ID NO: 1. Further variants of the disclosed polynucleotides can be constructed, e.g. by adapting the codon usage of polypeptide encoding nucleic acid sequences to the codon usage of a preferred species of microorganism, or by exchanging promoter regions and/or terminator regions or both of an expression cassette in order to adapt the expression of an encoded polynucleotide to a preferred species of microorganism or culture conditions. Further variants of the polynucleotides of the invention can be created by adding, deleting one or more polynucleotides from a polynucleotide, e.g. by shortening spacer regions between expression cassettes, by deleting introns, or deleting one or more codons of polypeptide encoding regions or complete functional elements of the polynucleotides, like complete, promoter, terminator or polypeptide encoding regions or complete expression cassettes. Alternatively, or in addition thereto, is is possible to create variants of the encoded polypeptide sequences, e.g. by introducing conserved amino acid substitutions or by adding or deleting one or more codons in order to enlarge or shorten the encoded polypeptides, or to create polypeptide fusions. Preferred polypeptide fusion comprise polypeptides for monitoring expression (e.g., green, yellow, blue or red fluorescent proteins, alkaline phosphatase and the like) or so called "tags" which may serve as a detectable marker or as an auxiliary measure for purification purposes. Tags for the different purposes are well known in the art and comprise FLAG-tags, 6-histidine-tags, MYC-tags and the like. The variant nucleic acid sequence shall still encode a polypeptide being involved in cornexistin and hydroxycornexistin synthesis. Accordingly, the polypeptide encoded by the variant in sequence length may comprise or consist of the domains of the polypeptide of the present invention conferring the said biological activity.

Variants in sequence identity and sequence length also encompass polynucleotides comprising a nucleic acid sequence which is capable of hybridizing to the aforementioned specific nucleic acid sequences, preferably, under stringent hybridization conditions. Alternatively, polynucleotide variants are obtainable by PCR-based techniques such as mixed oligonucleotide primer-based amplification of DNA, i.e. using degenerated primers against conserved domains of the polypeptides of the present invention. Conserved domains of the polypeptide of the present invention may be identified by a sequence comparison of the nucleic acid sequences of the polynucleotides or the amino acid sequences of the polypeptides of the present invention. Oligonucleotides suitable as PCR primers as well as suitable PCR conditions are described in the accompanying Examples. As a template, DNA or cDNA from bacteria, fungi, plants or animals may be used.

Accordingly, the polynucleotide and amino acid sequence information disclosed herein and in the sequence listing, can be used to identify or create variants in sequence identity and sequence length comprising a nucleic acid sequence being at least 80%, 82%, 84%, 86%, 88%, 90%, 91%, 92%, 93%, 94%, 95%, 96%, 97%, 98%, 99%, or 100% identical to the nucleic acid sequences and amino acid sequences disclosed herein. or can be used to identify or create sequence variants comprising a nucleic acid sequence or amino acid sequence having at least 80%, 82%, 84%, 86%, 88%, 90%, 91%, 92%, 93%, 94%, 95%, 96%, 97%, 98%, 99%, or 100% of the sequence length of the respective nucleic acid sequence or amino acid sequence disclosed herein. The variants in sequence identity or sequence length referred to above may, for example, differ only in less than 11, 10, 9, 8, 7, 6, 5, 4, 3, 2, 1 amino acids or nucleotides to the sequence as described by a sequence of SEQ ID NOs: 1 to 47, or SEQ ID NOs: 59 to 223, or SEQ ID NOs: 236, 237 or 238, having the highest sequence identity to the respective variant. The differences are in the case of amino acid sequences preferably due to conservative amino acid substitutions, amino acid insertions or N- or C-terminal additions of amino acids in the case of nucleic acid sequences, there are preferably due to silent mutations or codon optimization.

The variants in sequence identity referred to above, preferably, encode polypeptides retaining a significant extent, preferably, at least 10%, at least 20%, at least 30%, at least 40%, at least 50%, at least 60%, at least 70%, at least 80% or at least 90% of the activity exhibited by a polypeptide having an amino acid sequence as shown in at least one of SEQ ID NOs: 3, 5, 7, 9, 13, 15, 17, 19, 21, 23, 25, 27, 29; 31, 33, 35, 37, 39, 41, 43, 45, 47, 89, 105, 121, 142, 158, 169, 180, 196. The activity may be tested as described in the accompanying Examples, or by replacing the polynucleotide in *Paecilomyces divaricatus* having the same activity, or encoding a polypeptide having the same activity with the respective variant in sequence identity or sequence length, culturing the recombinant *Paecilomyces divaricatus* cells under conditions which allow for the production of cornexistin, hydroxycornexistin or both and comparing the amount of cornexistin, hydroxycornexistin or both with the amount of the cornexistin, hydroxycornexistin or both produced by the non-recombinant *Paecilomyces divaricatus* cultured under the same conditions. Preferably the amount of cornexistin is compared for polypeptides involved in cornexistin biosynthesis, while the amount of hydroxycornexistin is compared for polypeptides involved in hydroxycornexistin biosynthesis. The activity of polypeptides involved in cornexistin and hydroxycornexistin biosynthesis is measured by comparing the amount of the produced cornexistin, or, preferably, the total amount of the produced cornexistin and hydroxycornexystin.

Thus, the invention encompasses recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to the nucleic acid sequence as shown in SEQ ID NO: 1, or having at least 80%, 82%, 84%, 86%, 88%, 90%, 91%, 92%, 93%, 94%, 95%, 96%, 97%, 98%, 99%, or 100% of the sequence length of the nucleic acid sequence as shown in SEQ ID NO: 1, as well as polynucleotides comprising a nucleic acid sequence being at least 80%, 82%, 84%, 86%, 88%, 90%, 91%, 92%, 93%, 94%, 95%, 96%, 97%, 98%, 99%, or 100% identical to the nucleic acid sequence as shown by the sequence of nucleotide 1001 to nucleotide 57525 of SEQ ID NO: 1 or having at least 80%, 82%, 84%, 86%, 88%, 90%, 91%, 92%, 93%, 94%, 95%, 96%, 97%, 98%, 99%, or 100% of the sequence length of the nucleic acid sequence as shown by the sequence of nucleotide 1001 to nucleotide 57525 of SEQ ID NO: 1, and polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown by the sequence of nucleotide 12423 to nucleotide 52300 of SEQ ID NO: 1, or having at least 80%, 82%, 84%, 86%, 88%, 90%, 91%, 92%, 93%, 94%, 95%, 96%, 97%, 98%, 99%, or 100% of the sequence length of the nucleic acid sequence as shown by the sequence of nucleotide 12423 to nucleotide 52300 of SEQ ID NO: 1, and polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown by the sequence of nucleotide 7505 to nucleotide 55295 of SEQ ID NO: 1 or having at least 80%, 82%, 84%, 86%, 88%, 90%, 91%, 92%, 93%, 94%, 95%, 96%, 97%, 98%, 99%, or 100% of the sequence length of the nucleic acid sequence as shown by the sequence of nucleotide 7505 to nucleotide 55295 of SEQ ID NO: 1; and polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown by the sequence of nucleotide 18123 to nucleotide 52300 of SEQ ID NO: 1, or having at least 80%, 82%, 84%, 86%, 88%, 90%, 91%, 92%, 93%, 94%, 95%, 96%, 97%, 98%, 99%, or 100% of the sequence length of the nucleic acid sequence as shown by the sequence of nucleotide 18123 to nucleotide 52300 of SEQ ID NO: 1;

Further recombinant polynucleotides provided by the invention are polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 2, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 4, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 6, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 8, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 12, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 14, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 16, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 18, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 20, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 22, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 24, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 26, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 28, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 30, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 32, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 34, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 36, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 38, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 40, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 42, recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 44, and recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 46.

Other recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 3. Variants of polypeptides of SEQ ID NO: 3 having an amino acid sequence being at least 80%, 82%, 84%, 86%, 88%, 90%, 91%, 92%, 93%, 94%, 95%, 96%, 97%, 98%, 99%, or 100% identical to SEQ ID NO: 3 are, for example, but not excluding others, polypeptides having an amino acid sequence as shown by SEQ ID NOs: 3, 59, 60, 61, 62 and 63. Polypeptides having an amino acid sequence as shown by SEQ ID NOs: 3, 59, 60, 61, 62, 63 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 3, 59, 60, 61, 62 and/or 63 are preferred embodiments of the invention and are preferably used in the expression cassettes, recombinant organisms, methods and processes described herein.

Table 3 shows the % sequence identity of pairwise sequence alignments of SEQ ID NOs: 3, 59, 60, 61, 62 and 63. The parameters used for the pairwise sequence alignments are: Needleman-Wunsch algorithm of the EMBOSS Software Suite, #GAPMETHOD: NOGAPS, #GAPOPEN: 10, GAPEXTEND: 0,5, MATRIX: EBLOSUM62

TABLE 3

| | SEQ ID NO: 3 | SEQ ID NO: 59 | SEQ ID NO: 60 | SEQ ID NO: 61 | SEQ ID NO: 62 | SEQ ID NO: 63 |
|---|---|---|---|---|---|---|
| SEQ ID NO: 3 | 100 | 95 | 95 | 93 | 90 | 90 |
| SEQ ID NO: 59 | — | 100 | 90 | 89 | 86 | 87 |
| SEQ ID NO: 60 | — | — | 100 | 89 | 87 | 87 |
| SEQ ID NO: 61 | — | — | — | 100 | 85 | 84 |
| SEQ ID NO: 62 | — | — | — | — | 100 | 83 |
| SEQ ID NO: 63 | — | — | — | — | — | 100 |

Further recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 5, Variants of polypeptides of SEQ ID NO: 5 having an amino acid sequence being at least 80%, 82%, 84%, 86%, 88%, 90%, 91%, 92%, 93%, 94%, 95%, 96%, 97%, 98%, 99%, or 100% identical SEQ ID NO: 5 are, for example, but not excluding others, polypeptides having an amino acid sequence as shown by SEQ ID NOs: 5, 64, 65, 66, 67 and 68. Polypeptides having an amino acid sequence as shown by SEQ ID NOs: 5, 64, 65, 66, 67, 68 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 5, 64, 65, 66, 67 and/or 68 are preferred embodiments of the invention and are preferably used in the expression cassettes, recombinant organisms, methods and processes described herein. Table 4 shows the % sequence identity of pairwise sequence alignments of SEQ ID NOs: 5, 64, 65, 66, 67 and 68. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 4

|  | SEQ ID NO: 5 | SEQ ID NO: 64 | SEQ ID NO: 65 | SEQ ID NO: 66 | SEQ ID NO: 67 | SEQ ID NO: 68 |
|---|---|---|---|---|---|---|
| SEQ ID NO: 5 | 100 | 95 | 95 | 93 | 90 | 90 |
| SEQ ID NO: 64 | — | 100 | 90 | 89 | 86 | 86 |
| SEQ ID NO: 65 | — | — | 100 | 89 | 87 | 85 |
| SEQ ID NO: 66 | — | — | — | 100 | 84 | 85 |
| SEQ ID NO: 67 | — | — | — | — | 100 | 83 |
| SEQ ID NO: 68 | — | — | — | — | — | 100 |

Additional recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 7, Variants of polypeptides of SEQ ID NO: 7 having an amino acid sequence being at least 80%, 82%, 84%, 86%, 88%, 90%, 91%, 92%, 93%, 94%, 95%, 96%, 97%, 98%, 99%, or 100% identical SEQ ID NO: 7 are, for example, but not excluding others, polypeptides having an amino acid sequence as shown by SEQ ID NOs: 7, 69, 70, 71, 72 and 73. Polypeptides having an amino acid sequence as shown by SEQ ID NOs: 7, 69, 70, 71, 72, 73 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 7, 69, 70, 71, 72 and/or 73 are preferred embodiments of the invention and are preferably used in the expression cassettes, recombinant organisms, methods and processes described herein. Table 5 shows the % sequence identity of pairwise sequence alignments of SEQ ID NOs: 5, 64, 65, 66, 67 and 68. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 5

|  | SEQ ID NO: 7 | SEQ ID NO: 69 | SEQ ID NO: 70 | SEQ ID NO: 71 | SEQ ID NO: 72 | SEQ ID NO: 73 |
|---|---|---|---|---|---|---|
| SEQ ID NO: 7 | 100 | 95 | 95 | 93 | 90 | 90 |
| SEQ ID NO: 69 | — | 100 | 90 | 88 | 87 | 86 |
| SEQ ID NO: 70 | — | — | 100 | 89 | 88 | 85 |
| SEQ ID NO: 71 | — | — | — | 100 | 85 | 84 |
| SEQ ID NO: 72 | — | — | — | — | 100 | 83 |
| SEQ ID NO: 73 | — | — | — | — | — | 100 |

Further recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 9, Variants of polypeptides of SEQ ID NO: 9 having an amino acid sequence being at least 80%, 82%, 84%, 86%, 88%, 90%, 91%, 92%, 93%, 94%, 95%, 96%, 97%, 98%, 99%, or 100% identical SEQ ID NO: 9 are, for example, but not excluding others, polypeptides having an amino acid sequence as shown by SEQ ID NOs: 9, 74, 75, 76, 77 and 78. Polypeptides having an amino acid sequence as shown by SEQ ID NOs: 9, 74, 75, 76, 77, 78 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 9, 74, 75, 76, 77 and/or 78 are preferred embodiments of the invention and are preferably used in the expression cassettes, recombinant organisms, methods and processes described herein. Table 6 shows the % sequence identity of pairwise sequence alignments of SEQ ID NOs: 9, 74, 75, 76, 77 and 78. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 6

|  | SEQ ID NO: 9 | SEQ ID NO: 74 | SEQ ID NO: 75 | SEQ ID NO: 76 | SEQ ID NO: 77 | SEQ ID NO: 78 |
|---|---|---|---|---|---|---|
| SEQ ID NO: 9 | 100 | 95 | 95 | 93 | 90 | 90 |
| SEQ ID NO: 74 | — | 100 | 91 | 90 | 86 | 87 |
| SEQ ID NO: 75 | — | — | 100 | 89 | 86 | 86 |
| SEQ ID NO: 76 | — | — | — | 100 | 85 | 84 |
| SEQ ID NO: 77 | — | — | — | — | 100 | 82 |
| SEQ ID NO: 78 | — | — | — | — | — | 100 |

Other recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 13, Variants of polypeptides of SEQ ID NO: 13 having an amino acid sequence being at least 80%, 82%, 84%, 86%, 88%, 90%, 91%, 92%, 93%, 94%, 95%, 96%, 97%, 98%, 99%, or 100% identical SEQ ID NO: 13 are, for example, but not excluding others, polypeptides having an amino acid sequence as shown by SEQ ID NOs: 13, 79, 80, 81, 82 and 83. Polypeptides having an amino acid sequence as shown by SEQ ID NOs: 13, 79, 80, 81, 82, 83 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 13, 79, 80, 81, 82 and/or 83 are preferred embodiments of the invention and are preferably used in the expression cassettes, recombinant organisms, methods and processes described herein. Table 7 shows the % sequence identity of pairwise sequence alignments of SEQ ID NOs: 13, 79, 80, 81, 82 and 83. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 7

|  | SEQ ID NO: 13 | SEQ ID NO: 79 | SEQ ID NO: 80 | SEQ ID NO: 81 | SEQ ID NO: 82 | SEQ ID NO: 83 |
|---|---|---|---|---|---|---|
| SEQ ID NO: 13 | 100 | 95 | 95 | 92 | 90 | 90 |
| SEQ ID NO: 79 | — | 100 | 90 | 88 | 86 | 87 |
| SEQ ID NO: 80 | — | — | 100 | 89 | 87 | 87 |
| SEQ ID NO: 81 | — | — | — | 100 | 84 | 87 |
| SEQ ID NO: 82 | — | — | — | — | 100 | 83 |
| SEQ ID NO: 83 | — | — | — | — | — | 100 |

Additional recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 15, Variants of polypeptides of SEQ ID NO: 15 having an amino acid sequence being at least 80%, 82%, 84%, 86%, 88%, 90%, 91%, 92%, 93%, 94%, 95%, 96%, 97%, 98%, 99%, or 100% identical SEQ ID NO: 15 are, for example, but not excluding others, polypeptides having an amino acid sequence as shown by SEQ ID NOs: 15, 84, 85, 86, 87, 88, 89, 90, 91, 92, 93 and 94. Polypeptides having an amino acid sequence as shown by SEQ ID NOs: 15, 84, 85, 86, 87, 88, 89, 90, 91, 92, 93, 94 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 15, 84, 85, 86, 87, 88, 89, 90, 91, 92, 93 and/or 94, preferably 15 or 89, are preferred embodiments of the invention and are preferably used in the expression cassettes, recombinant organisms, methods and processes described herein. Table 8 shows the (:)/0 sequence identity of pairwise sequence alignments of SEQ ID NOs: 15, 84, 85, 86, 87, 88, 89, 90, 91, 92, 93 and 94. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 8

| SEQ ID NO: | 75 | 84 | 85 | 86 | 87 | 88 | 89 | 90 | 91 | 92 | 93 | 94 |
|---|---|---|---|---|---|---|---|---|---|---|---|---|
| 15 | 100 | 95 | 95 | 93 | 90 | 90 | 100 | 95 | 95 | 93 | 90 | 90 |
| 84 | — | 100 | 91 | 89 | 87 | 86 | 94 | 89 | 89 | 88 | 85 | 85 |
| 85 | — | — | 100 | 89 | 86 | 86 | 95 | 89 | 90 | 89 | 85 | 86 |
| 86 | — | — | — | 100 | 86 | 85 | 92 | 88 | 88 | 86 | 84 | 84 |
| 87 | — | — | — | — | 100 | 83 | 89 | 85 | 86 | 84 | 83 | 81 |
| 88 | — | — | — | — | — | 100 | 90 | 85 | 87 | 85 | 82 | 82 |
| 89 | — | — | — | — | — | — | 100 | 95 | 95 | 93 | 90 | 90 |
| 90 | — | — | — | — | — | — | — | 100 | 90 | 88 | 86 | 86 |
| 91 | — | — | — | — | — | — | — | — | 100 | 89 | 86 | 87 |
| 92 | — | — | — | — | — | — | — | — | — | 100 | 85 | 84 |
| 93 | — | — | — | — | — | — | — | — | — | — | 100 | 83 |
| 94 | — | — | — | — | — | — | — | — | — | — | — | 100 |

Further recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 17, Variants of polypeptides of SEQ ID NO: 17 having an amino acid sequence being at least 80%, 82%, 84%, 86%, 88%, 90%, 91%, 92%, 93%, 94%, 95%, 96%, 97%, 98%, 99%, or 100% identical SEQ ID NO: 17 are, for example, but not excluding others, polypeptides having an amino acid sequence as shown by SEQ ID NOs: 17, 95, 96, 97, 98 and 99. Polypeptides having an amino acid sequence as shown by SEQ ID NOs: 17, 95, 96, 97, 98, 99 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 17, 95, 96, 97, 98 and/or 99 are preferred embodiments of the invention and are preferably used in the expression cassettes, recombinant organisms, methods and processes described herein. Table 9 shows the % sequence identity of pairwise sequence alignments of SEQ ID NOs: 17, 95, 96, 97, 98 and 99. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 9

| | SEQ ID NO: 17 | SEQ ID NO: 95 | SEQ ID NO: 96 | SEQ ID NO: 97 | SEQ ID NO: 98 | SEQ ID NO: 99 |
|---|---|---|---|---|---|---|
| SEQ ID NO: 17 | 100 | 95 | 95 | 93 | 90 | 90 |
| SEQ ID NO: 95 | — | 100 | 91 | 89 | 86 | 87 |
| SEQ ID NO: 96 | — | — | 100 | 89 | 85 | 86 |
| SEQ ID NO: 97 | — | — | — | 100 | 85 | 85 |
| SEQ ID NO: 98 | — | — | — | — | 100 | 83 |
| SEQ ID NO: 99 | — | — | — | — | — | 100 |

Further recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 19, Variants of polypeptides of SEQ ID NO: 19 having an amino acid sequence being at least 80%, 82%, 84%, 86%, 88%, 90%, 91%, 92%, 93%, 94%, 95%, 96%, 97%, 98%, 99%, or 100% identical SEQ ID NO: 19 are, for example, but not excluding others, polypeptides having an amino acid sequence as shown by SEQ ID NOs: 19, 100, 101, 102, 103, 104, 105, 106, 107, 108, 109 and 110. Polypeptides having an amino acid sequence as shown by SEQ ID NOs: 19, 100, 101, 102, 103, 104, 105, 106, 107, 108, 109, 110 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 19, 100, 101, 102, 103, 104, 105, 106, 107, 108, 109 and/or 110, preferably 105, 106, 107, 108, 109 and/or 110, more preferred 105, are preferred embodiments of the invention and are preferably used in the expression cassettes, recombinant organisms, methods and processes described herein. Table 10 shows the % sequence identity of pairwise sequence alignments of SEQ ID NOs: 19, 100, 101, 102, 103, 104, 105, 106, 107, 108, 109, 110. The parameters used of the pairwise sequence alignments are: Needleman-Wunsch algorithm for the EMBOSS Software Suite, #GAPMETHOD: NOGAPS, #GAPOPEN:10, GAPEXTEND: 0,5, MATRIX: EBLOSUM62

TABLE 10

| SEQ ID NO: | 19 | 100 | 101 | 102 | 103 | 104 | 105 | 106 | 107 | 108 | 109 | 110 |
|---|---|---|---|---|---|---|---|---|---|---|---|---|
| 19 | 100 | 95 | 95 | 93 | 90 | 90 | 100 | 94 | 94 | 92 | 90 | 91 |
| 100 | — | 100 | 90 | 89 | 86 | 86 | 95 | 90 | 90 | 88 | 87 | 87 |
| 101 | — | — | 100 | 88 | 87 | 87 | 95 | 91 | 90 | 88 | 86 | 88 |
| 102 | — | — | — | 100 | 86 | 85 | 93 | 88 | 88 | 87 | 85 | 85 |
| 103 | — | — | — | — | 100 | 81 | 90 | 86 | 86 | 84 | 83 | 84 |
| 104 | — | — | — | — | — | 100 | 90 | 87 | 85 | 84 | 82 | 84 |
| 105 | — | — | — | — | — | — | 100 | 95 | 95 | 93 | 90 | 90 |
| 106 | — | — | — | — | — | — | — | 100 | 90 | 89 | 87 | 87 |
| 107 | — | — | — | — | — | — | — | — | 100 | 90 | 86 | 86 |
| 108 | — | — | — | — | — | — | — | — | — | 100 | 86 | 84 |
| 109 | — | — | — | — | — | — | — | — | — | — | 100 | 83 |
| 110 | — | — | — | — | — | — | — | — | — | — | — | 100 |

Other recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 21, Variants of polypeptides of SEQ ID NO: 21 having an amino acid sequence being at least 80%, 82%, 84%, 86%, 88%, 90%, 91%, 92%, 93%, 94%, 95%, 96%, 97%, 98%, 99%, or 100% identical SEQ ID NO: 21 are, for example, but not excluding others, polypeptides having an amino acid sequence as shown by SEQ ID NOs: 21, 111, 112, 113, 114 and 115. Polypeptides having an amino acid sequence as shown by SEQ ID NOs: 21, 111, 112, 113, 114, 115 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 21, 111, 112, 113, 114 and/or 115 are preferred embodiments of the invention and are preferably used in the expression cassettes, recombinant organisms, methods and processes described herein. Table 11 shows the % sequence identity of pairwise sequence alignments of SEQ ID NOs: 21, 111, 112, 113, 114 and 115. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 11

| | SEQ ID NO: 21 | SEQ ID NO: 111 | SEQ ID NO: 112 | SEQ ID NO: 113 | SEQ ID NO: 114 | SEQ ID NO: 115 |
|---|---|---|---|---|---|---|
| SEQ ID NO: 21 | 100 | 95 | 95 | 93 | 90 | 90 |
| SEQ ID NO: 111 | — | 100 | 91 | 89 | 85 | 87 |
| SEQ ID NO: 112 | — | — | 100 | 89 | 86 | 87 |
| SEQ ID NO: 113 | — | — | — | 100 | 84 | 85 |
| SEQ ID NO: 114 | — | — | — | — | 100 | 83 |
| SEQ ID NO: 115 | — | — | — | — | — | 100 |

Further recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 23, Variants of polypeptides of SEQ ID NO: 23 having an amino acid sequence being at least 80%, 82%, 84%, 86%, 88%, 90%, 91%, 92%, 93%, 94%, 95%, 96%, 97%, 98%, 99%, or 100% identical SEQ ID NO: 23 are, for example, but not excluding others, polypeptides having an amino acid sequence as shown by SEQ ID NOs: 23, 116, 117, 118, 119, 120, 121, 122, 123, 124, 125 and 126. Polypeptides having an amino acid sequence as shown by SEQ ID NOs: 23, 116, 117, 118, 119, 120, 121, 122, 123, 124, 125, 126 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 23, 116, 117, 118, 119, 120, 121, 122, 123, 124, 125 and/or 126 preferably 121, 122, 123, 124, 125 and/or 126, more preferred 121 are preferred embodiments of the invention and are preferably used in the expression cassettes, recombinant organisms, methods and processes described herein. Table 12 shows the % sequence identity of pairwise sequence alignments of SEQ ID NOs: 23, 116, 117, 118, 119, 120, 121, 122, 123, 124, 125 and 126. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 12

| SEQ ID NO: | 23 | 116 | 117 | 118 | 119 | 120 | 121 | 122 | 123 | 124 | 125 | 126 |
|---|---|---|---|---|---|---|---|---|---|---|---|---|
| 23 | 100 | 95 | 95 | 93 | 90 | 90 | 98 | 93 | 94 | 92 | 89 | 89 |
| 116 | — | 100 | 91 | 89 | 87 | 87 | 93 | 90 | 89 | 88 | 86 | 85 |
| 117 | — | — | 100 | 90 | 87 | 87 | 93 | 89 | 90 | 89 | 86 | 85 |
| 118 | — | — | — | 100 | 86 | 86 | 91 | 88 | 87 | 87 | 83 | 84 |
| 119 | — | — | — | — | 100 | 84 | 88 | 85 | 85 | 84 | 82 | 80 |
| 120 | — | — | — | — | — | 100 | 88 | 85 | 85 | 84 | 82 | 81 |
| 121 | — | — | — | — | — | — | 100 | 95 | 95 | 93 | 90 | 90 |
| 122 | — | — | — | — | — | — | — | 100 | 90 | 89 | 87 | 87 |
| 123 | — | — | — | — | — | — | — | — | 100 | 89 | 86 | 87 |
| 124 | — | — | — | — | — | — | — | — | — | 100 | 86 | 85 |
| 125 | — | — | — | — | — | — | — | — | — | — | 100 | 83 |
| 126 | — | — | — | — | — | — | — | — | — | — | — | 100 |

Figure 14A:
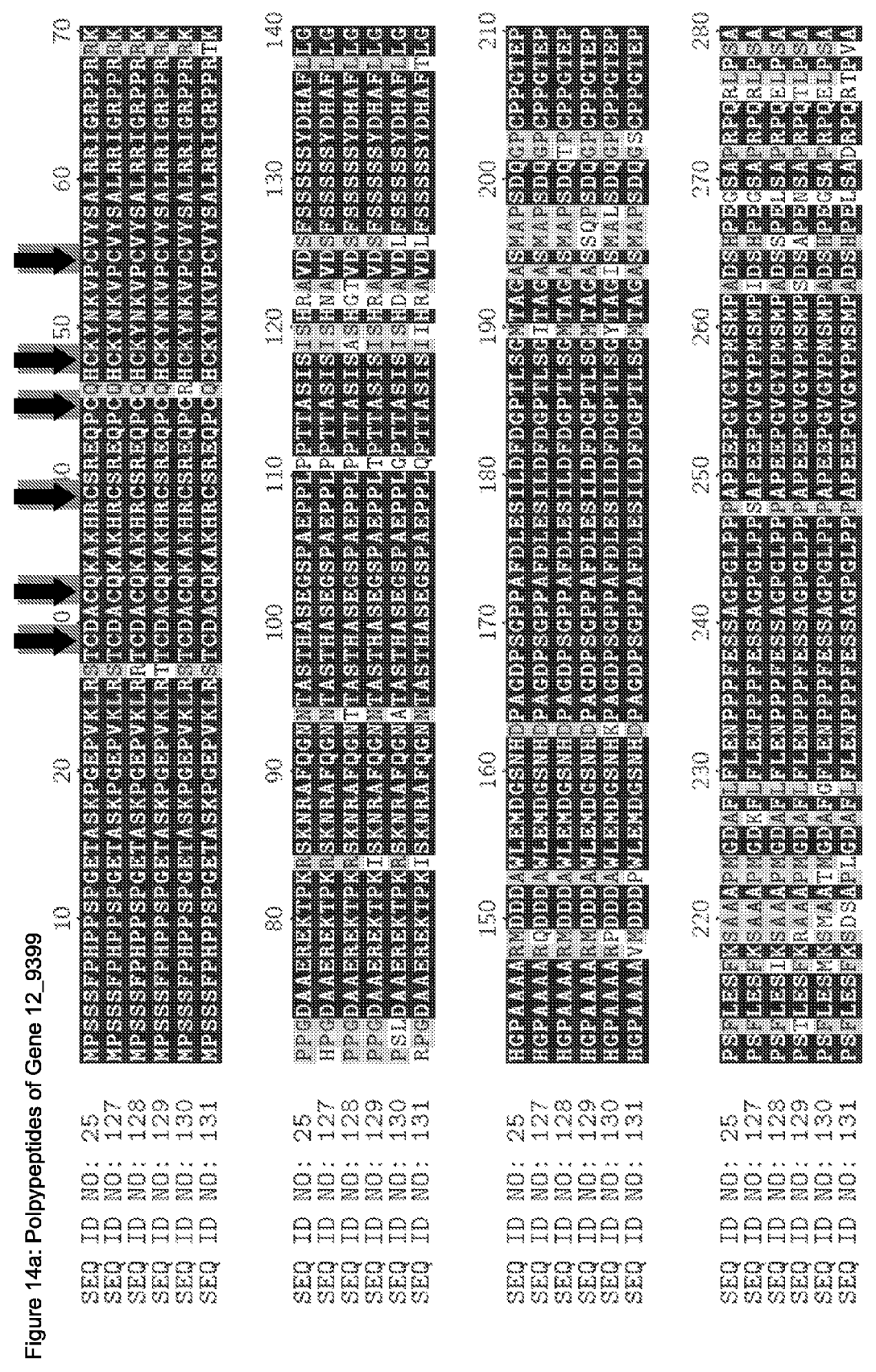
Figure 14B:
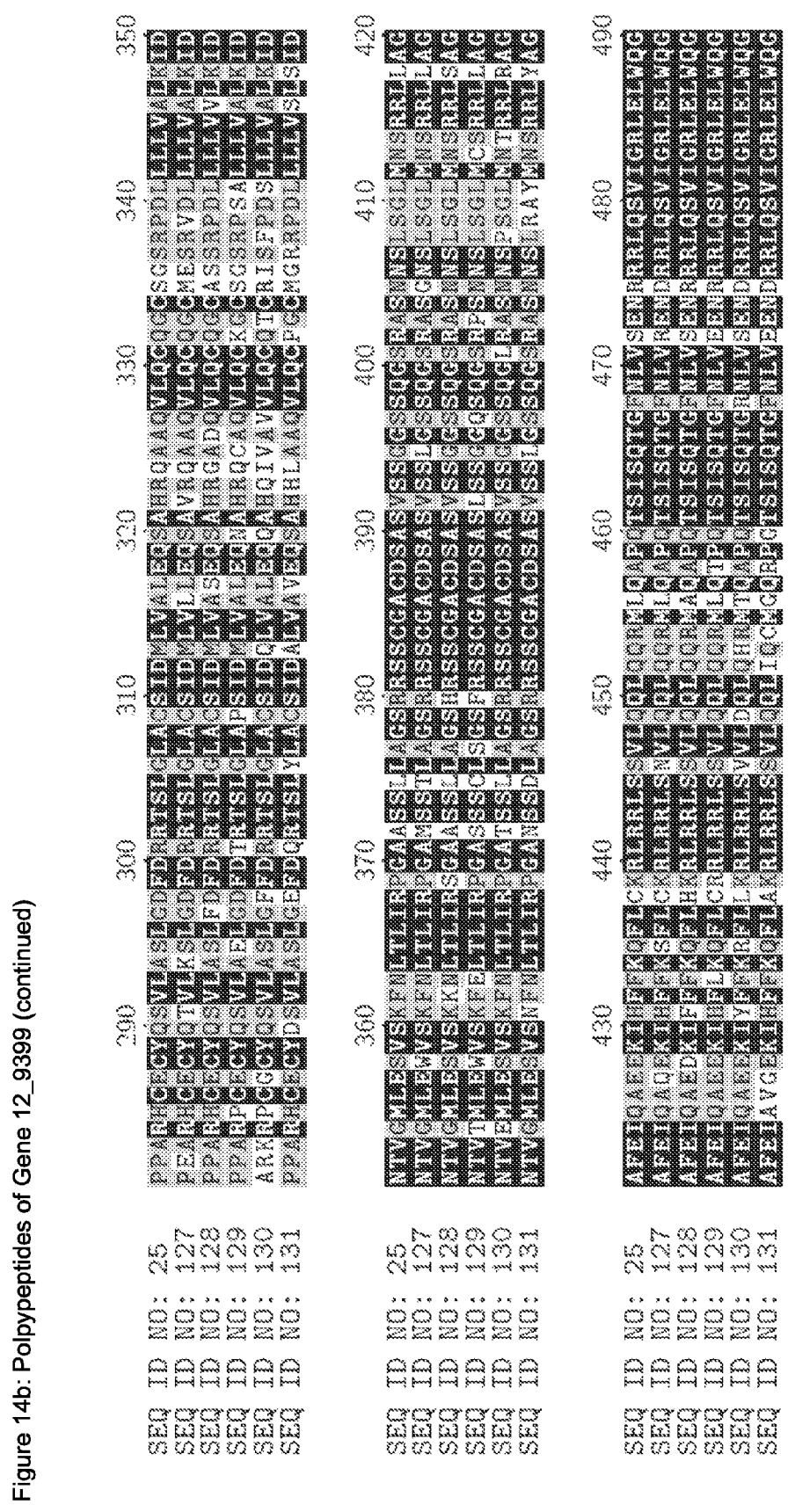

Additional recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 25, Variants of polypeptides of SEQ ID NO: 25 having an amino acid sequence being at least 80%, 82%, 84%, 86%, 88%, 90%, 91%, 92%, 93%, 94%, 95%, 96%, 97%, 98%, 99%, or 100% identical SEQ ID NO: 25 are, for example, but not excluding others, polypeptides having an amino acid sequence as shown by SEQ ID NOs: 25, 127, 128, 129, 130 and 131. Polypeptides having an amino acid sequence as shown by SEQ ID NOs: 25, 127, 128, 129, 130, 131 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 25, 127, 128, 129, 130 and/or 131 are preferred embodiments of the invention and are preferably used in the expression cassettes, recombinant organisms, methods and processes described herein. Variants of SEQ ID NO: 25 will preferably comprise the six conserved cysteines depicted in FIG. 14a. Which are necessary for complexation of the two Zinc ions and correct folding of the $Zn_2C_6$ zinc finger DNA binding region. Basic amino acids present between the second and third cysteine counted from the N-terminal end, are preferably conserved, as non-conservative mutations frequently abolish the DNA binding capacity of this DNA binding domain. The region between the the third and fourth cysteine represents a variable subregion, conservative mutations in this variable subregion usually show little effect. This region comprises a proline in front of the fourth cysteine. This proline it thought to support a turn of the amino acid chain, which is necessary for correct folding. However this proline is not absolutely required and can in many cases be replaced for example with leucine, glutamine, or arginine, in particular, if a further proline has been introduced in this region. Table 13 shows the % sequence identity of pairwise sequence alignments of SEQ ID NOs: 25, 127, 128, 129, 130 and 131. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 13

| | SEQ ID NO: 25 | SEQ ID NO: 127 | SEQ ID NO: 128 | SEQ ID NO: 129 | SEQ ID NO: 130 | SEQ ID NO: 131 |
|---|---|---|---|---|---|---|
| SEQ ID NO: 25 | 100 | 95 | 95 | 93 | 90 | 90 |
| SEQ ID NO: 127 | — | 100 | 90 | 89 | 87 | 87 |

TABLE 13-continued

| | SEQ ID NO: 25 | SEQ ID NO: 127 | SEQ ID NO: 128 | SEQ ID NO: 129 | SEQ ID NO: 130 | SEQ ID NO: 131 |
|---|---|---|---|---|---|---|
| SEQ ID NO: 128 | — | — | 100 | 89 | 87 | 87 |
| SEQ ID NO: 129 | — | — | — | 100 | 85 | 85 |
| SEQ ID NO: 130 | — | — | — | — | 100 | 83 |
| SEQ ID NO: 131 | — | — | — | — | — | 100 |

Further recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 27, Variants of polypeptides of SEQ ID NO: 27 having an amino acid sequence being at least 80%, 82%, 84%, 86%, 88%, 90%, 91%, 92%, 93%, 94%, 95%, 96%, 97%, 98%, 99%, or 100% identical SEQ ID NO: 27 are, for example, but not excluding others, polypeptides having an amino acid sequence as shown by SEQ ID NOs: 27, 132, 133, 134, 135 and 136. Polypeptides having an amino acid sequence as shown by SEQ ID NOs: 27, 132, 133, 134, 135, 136 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 27, 132, 133, 134, 135 and/or 136 are preferred embodiments of the invention and are preferably used in the expression cassettes, recombinant organisms, methods and processes described herein. Table 14 shows the % sequence identity of pairwise sequence alignments of SEQ ID NOs: 27, 132, 133, 134, 135 and 136. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 14

| | SEQ ID NO: 27 | SEQ ID NO: 132 | SEQ ID NO: 133 | SEQ ID NO: 134 | SEQ ID NO: 135 | SEQ ID NO: 136 |
|---|---|---|---|---|---|---|
| SEQ ID NO: 27 | 100 | 95 | 95 | 93 | 90 | 90 |
| SEQ ID NO: 132 | — | 100 | 91 | 89 | 86 | 86 |
| SEQ ID NO: 133 | — | — | 100 | 89 | 87 | 88 |
| SEQ ID NO: 134 | — | — | — | 100 | 85 | 86 |
| SEQ ID NO: 135 | — | — | — | — | 100 | 83 |
| SEQ ID NO: 136 | — | — | — | — | — | 100 |

Further recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 29, Variants of polypeptides of SEQ ID NO: 29 having an amino acid sequence being at least 80%, 82%, 84%, 86%, 88%, 90%, 91%, 92%, 93%, 94%, 95%, 96%, 97%, 98%, 99%, or 100% identical SEQ ID NO: 29 are, for example, but not excluding others, polypeptides having an amino acid sequence as shown by SEQ ID NOs: 29, 137, 138, 139, 140, 141, 142, 143, 144, 145, 146, and 147. Polypeptides having an amino acid sequence as shown by SEQ ID NOs: 29, 137, 138, 139, 140, 141, 142, 143, 144, 145, 146 and 147 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 29, 137, 138, 139, 140, 141, 142, 143, 144, 145, 146 and/or 147, preferably 29, 137, 138, 139, 140 and/or 141, more preferred 29, are preferred embodiments of the invention and are preferably used in the expression cassettes, recombinant organisms, methods and processes described herein. Table 15 shows the % sequence identity of pairwise sequence alignments of SEQ ID NOs: 29, 137, 138, 139, 140, 141, 142, 143, 144, 145, 146 and 147. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 15

| SEQ ID NO: | 29 | 137 | 138 | 139 | 140 | 141 | 142 | 143 | 144 | 145 | 146 | 147 |
|---|---|---|---|---|---|---|---|---|---|---|---|---|
| 29 | 100 | 95 | 95 | 93 | 90 | 90 | 100 | 95 | 95 | 93 | 90 | 90 |
| 137 | — | 100 | 91 | 90 | 87 | 86 | 95 | 91 | 91 | 88 | 87 | 87 |
| 138 | — | — | 100 | 88 | 87 | 87 | 95 | 90 | 90 | 89 | 86 | 86 |
| 139 | — | — | — | 100 | 86 | 87 | 93 | 88 | 89 | 88 | 84 | 84 |
| 140 | — | — | — | — | 100 | 84 | 90 | 87 | 88 | 85 | 83 | 85 |
| 141 | — | — | — | — | — | 100 | 90 | 87 | 86 | 85 | 83 | 81 |
| 142 | — | — | — | — | — | — | 100 | 95 | 95 | 93 | 90 | 90 |
| 143 | — | — | — | — | — | — | — | 100 | 90 | 90 | 87 | 86 |
| 144 | — | — | — | — | — | — | — | — | 100 | 89 | 87 | 87 |
| 145 | — | — | — | — | — | — | — | — | — | 100 | 85 | 86 |
| 146 | — | — | — | — | — | — | — | — | — | — | 100 | 83 |
| 147 | — | — | — | — | — | — | — | — | — | — | — | 100 |

Additional recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 31, Variants of polypeptides of SEQ ID NO: 31 having an amino acid sequence being at least 80%, 82%, 84%, 86%, 88%, 90%, 91%, 92%, 93%, 94%, 95%, 96%, 97%, 98%, 99%, or 100% identical SEQ ID NO: 31 are, for example, but not excluding others, polypeptides having an amino acid sequence as shown by SEQ ID NOs: 31, 148, 149, 150, 151 and 152. Polypeptides having an amino acid sequence as shown by SEQ ID NOs: 31, 148, 149, 150, 151, 152 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 31, 148, 149, 150, 151 and/or 152 are preferred embodiments of the invention and are preferably used in the expression cassettes, recombinant organisms, methods and processes described herein. Table 16 shows the % sequence identity of pairwise sequence alignments of SEQ ID NOs: 31, 148, 149, 150, 151 and 152. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 16

| | SEQ ID NO: 31 | SEQ ID NO: 148 | SEQ ID NO: 149 | SEQ ID NO: 150 | SEQ ID NO: 151 | SEQ ID NO: 152 |
|---|---|---|---|---|---|---|
| SEQ ID NO: 31 | 100 | 95 | 95 | 93 | 90 | 90 |
| SEQ ID NO: 148 | — | 100 | 91 | 88 | 87 | 87 |
| SEQ ID NO: 149 | — | — | 100 | 89 | 87 | 87 |
| SEQ ID NO: 150 | — | — | — | 100 | 86 | 86 |

TABLE 16-continued

| | SEQ ID NO: 31 | SEQ ID NO: 148 | SEQ ID NO: 149 | SEQ ID NO: 150 | SEQ ID NO: 151 | SEQ ID NO: 152 |
|---|---|---|---|---|---|---|
| SEQ ID NO: 151 | — | — | — | — | 100 | 83 |
| SEQ ID NO: 152 | — | — | — | — | — | 100 |

Further recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 33, Variants of polypeptides of SEQ ID NO: 33 having an amino acid sequence being at least 80%, 82%, 84%, 86%, 88%, 90%, 91%, 92%, 93%, 94%, 95%, 96%, 97%, 98%, 99%, or 100% identical SEQ ID NO: 33 are, for example, but not excluding others, polypeptides having an amino acid sequence as shown by SEQ ID NOs: 33, 153, 154, 155, 156, 157, 158, 159, 160, 161, 162 and 163. Polypeptides having an amino acid sequence as shown by SEQ ID NOs: 33, 153, 154, 155, 156, 157, 158, 159, 160, 161, 162, 163 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 33, 153, 154, 155, 156, 157, 158, 159, 160, 161, 162, 163, preferably 158, 159, 160, 161, 162, 163, more preferred 158, are preferred embodiments of the invention and are preferably used in the expression cassettes, recombinant organisms, methods and processes described herein. Table 17 shows the % sequence identity of pairwise sequence alignments of SEQ ID NOs: 33, 153, 154, 155, 156, 157, 158, 159, 160, 161, 162 and 163. The parameters used for the pairwise sequence alignments are: Needleman-Wunsch algorithm of the EMBOSS Software Suite, #GAPMETHOD: NOGAPS, #GAPOPEN: 10, GAPEXTEND: 0,5, MATRIX: EBLOSUM62

TABLE 17

| SEQ ID NO: | 33 | 153 | 154 | 155 | 156 | 157 | 158 | 159 | 160 | 161 | 162 | 163 |
|---|---|---|---|---|---|---|---|---|---|---|---|---|
| 33 | 100 | 95 | 95 | 93 | 90 | 90 | 100 | 95 | 95 | 93 | 90 | 90 |
| 153 | — | 100 | 91 | 88 | 88 | 85 | 95 | 91 | 90 | 88 | 87 | 87 |
| 154 | — | — | 100 | 89 | 87 | 86 | 95 | 90 | 90 | 88 | 86 | 86 |
| 155 | — | — | — | 100 | 84 | 85 | 93 | 88 | 89 | 87 | 85 | 84 |
| 156 | — | — | — | — | 100 | 82 | 90 | 86 | 86 | 85 | 82 | 82 |
| 157 | — | — | — | — | — | 100 | 90 | 86 | 86 | 85 | 83 | 83 |
| 158 | — | — | — | — | — | — | 100 | 95 | 95 | 93 | 90 | 90 |
| 159 | — | — | — | — | — | — | — | 100 | 92 | 89 | 87 | 87 |
| 160 | — | — | — | — | — | — | — | — | 100 | 89 | 86 | 86 |
| 161 | — | — | — | — | — | — | — | — | — | 100 | 84 | 85 |
| 162 | — | — | — | — | — | — | — | — | — | — | 100 | 83 |
| 163 | — | — | — | — | — | — | — | — | — | — | — | 100 |

Other recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 35, Variants of polypeptides of SEQ ID NO: 35 having an amino acid sequence being at least 80%, 82%, 84%, 86%, 88%, 90%, 91%, 92%, 93%, 94%, 95%, 96%, 97%, 98%, 99%, or 100% identical SEQ ID NO: 35 are, for example, but not excluding others, polypeptides having an amino acid sequence as shown by SEQ ID NOs: 35, 164, 165, 166, 167, 168, 169, 170, 171, 172, 173 and 174. Polypeptides having an amino acid sequence as shown by SEQ ID NOs: 35, 164, 165, 166, 167, 168, 169, 170, 171, 172, 173 and 174 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 35, 164, 165, 166, 167, 168, 169, 170, 171, 172, 173, 174, preferably 169, 170, 171, 172, 173, 174, more preferred 169, are preferred embodiments of the invention and are preferably used in the expression cassettes, recombinant organisms, methods and processes described herein. Table 18 shows the % sequence identity of pairwise sequence alignments of SEQ ID NOs: 35, 164, 165, 166, 167, 168, 169, 170, 171, 172, 173 and 174. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 18

| SEQ ID NO: | 35 | 164 | 165 | 166 | 167 | 168 | 169 | 170 | 171 | 172 | 173 | 174 |
|---|---|---|---|---|---|---|---|---|---|---|---|---|
| 35 | 100 | 95 | 95 | 93 | 90 | 90 | 99 | 94 | 94 | 92 | 89 | 89 |
| 164 | — | 100 | 91 | 90 | 85 | 88 | 94 | 88 | 90 | 90 | 88 | 86 |
| 165 | — | — | 100 | 90 | 87 | 89 | 94 | 90 | 90 | 88 | 87 | 87 |
| 166 | — | — | — | 100 | 87 | 87 | 91 | 88 | 91 | 88 | 88 | 84 |
| 167 | — | — | — | — | 100 | 83 | 88 | 85 | 85 | 86 | 82 | 81 |
| 168 | — | — | — | — | — | 100 | 88 | 85 | 85 | 84 | 85 | 86 |
| 169 | — | — | — | — | — | — | 100 | 95 | 95 | 93 | 90 | 90 |
| 170 | — | — | — | — | — | — | — | 100 | 90 | 89 | 87 | 87 |
| 171 | — | — | — | — | — | — | — | — | 100 | 89 | 87 | 88 |
| 172 | — | — | — | — | — | — | — | — | — | 100 | 87 | 87 |
| 173 | — | — | — | — | — | — | — | — | — | — | 100 | 85 |
| 174 | — | — | — | — | — | — | — | — | — | — | — | 100 |

Further recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 37, Variants of polypeptides of SEQ ID NO: 37 having an amino acid sequence being at least 80%, 82%, 84%, 86%, 88%, 90%, 91%, 92%, 93%, 94%, 95%, 96%, 97%, 98%, 99%, or 100% identical SEQ ID NO: 37 are, for example, but not excluding others, polypeptides having an amino acid sequence as shown by SEQ ID NOs: 37, 175, 176, 177, 178, 179, 180, 181, 182, 183, 184 and 185. Polypeptides having an amino acid sequence as shown by SEQ ID NOs: 37, 175, 176, 177, 178, 179, 180, 181, 182, 183, 184 and 185 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 37, 175, 176, 177, 178, 179, 180, 181, 182, 183, 184, 185, preferabyl 37 or 180, are preferred embodiments of the invention and are preferably used in the expression cassettes, recombinant organisms, methods and processes described herein. Table 19 shows the % sequence identity of pairwise sequence alignments of SEQ ID NOs: 37, 175, 176, 177, 178, 179, 180, 181, 182, 183, 184 and 185. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 19

| SEQ ID NO: | 37 | 175 | 176 | 177 | 178 | 179 | 180 | 181 | 182 | 183 | 184 | 185 |
|---|---|---|---|---|---|---|---|---|---|---|---|---|
| 37 | 100 | 95 | 95 | 93 | 90 | 90 | 100 | 95 | 95 | 93 | 90 | 90 |
| 175 | — | 100 | 91 | 89 | 86 | 86 | 95 | 90 | 90 | 89 | 86 | 86 |
| 176 | — | — | 100 | 89 | 86 | 87 | 95 | 90 | 90 | 88 | 87 | 86 |
| 177 | — | — | — | 100 | 85 | 84 | 93 | 88 | 89 | 87 | 85 | 84 |
| 178 | — | — | — | — | 100 | 83 | 90 | 87 | 86 | 86 | 83 | 81 |
| 179 | — | — | — | — | — | 100 | 90 | 86 | 86 | 85 | 83 | 81 |
| 180 | — | — | — | — | — | — | 100 | 95 | 95 | 93 | 90 | 90 |
| 181 | — | — | — | — | — | — | — | 100 | 90 | 89 | 86 | 86 |
| 182 | — | — | — | — | — | — | — | — | 100 | 89 | 86 | 86 |
| 183 | — | — | — | — | — | — | — | — | — | 100 | 85 | 84 |
| 184 | — | — | — | — | — | — | — | — | — | — | 100 | 84 |
| 185 | — | — | — | — | — | — | — | — | — | — | — | 100 |

Other recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 39, Variants of polypeptides of SEQ ID NO: 39 having an amino acid sequence being at least 80%, 82%, 84%, 86%, 88%, 90%, 91%, 92%, 93%, 94%, 95%, 96%, 97%, 98%, 99%, or 100% identical SEQ ID NO: 39 are, for example, but not excluding others, polypeptides having an amino acid sequence as shown by SEQ ID NOs: 39, 186, 187, 188, 189 and 190. Polypeptides having an amino acid sequence as shown by SEQ ID NOs: 39, 186, 187, 188, 189, 190 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 39, 186, 187, 188, 189 and/or 190 are preferred embodiments of the invention and are preferably used in the expression cassettes, recombinant organisms, methods and processes described herein. Table 20 shows the % sequence identity of pairwise sequence alignments of SEQ ID NOs: 39, 186, 187, 188, 189 and 190. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 20

| | SEQ ID NO: 39 | SEQ ID NO: 186 | SEQ ID NO: 187 | SEQ ID NO: 188 | SEQ ID NO: 189 | SEQ ID NO: 190 |
|---|---|---|---|---|---|---|
| SEQ ID NO: 39 | 100 | 95 | 95 | 93 | 90 | 90 |
| SEQ ID NO: 186 | — | 100 | 91 | 89 | 87 | 87 |
| SEQ ID NO: 187 | — | — | 100 | 89 | 87 | 86 |
| SEQ ID NO: 188 | — | — | — | 100 | 86 | 86 |
| SEQ ID NO: 189 | — | — | — | — | 100 | 84 |
| SEQ ID NO: 190 | — | — | — | — | — | 100 |

Further recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 41, Variants of polypeptides of SEQ ID NO: 41 having an amino acid sequence being at least 80%, 82%, 84%, 86%, 88%, 90%, 91%, 92%, 93%, 94%, 95%, 96%, 97%, 98%, 99%, or 100% identical SEQ ID NO: 41 are, for example, but not excluding others, polypeptides having an amino acid sequence as shown by SEQ ID NOs: 41, 191, 192, 193, 194, 195, 196, 197, 198, 199, 200 or 201. Polypeptides having an amino acid sequence as shown by SEQ ID NOs: 41, 191, 192, 193, 194, 195, 196, 197, 198, 199, 200, 201 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 41, 191, 192, 193, 194, 195, 196, 197, 198, 199, 200, 201 preferabyl 41 or 196, are preferred embodiments of the invention and are preferably used in the expression cassettes, recombinant organisms, methods and processes described herein. Table 21 shows the % sequence identity of pairwise sequence alignments of SEQ ID NOs: 41, 191, 192, 193, 194, 195, 196, 197, 198, 199, 200 and 201. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 21

| SEQ ID NO: | 41 | 191 | 192 | 193 | 194 | 195 | 196 | 197 | 198 | 199 | 200 | 201 |
|---|---|---|---|---|---|---|---|---|---|---|---|---|
| 41 | 100 | 95 | 95 | 93 | 90 | 90 | 100 | 95 | 95 | 93 | 90 | 90 |
| 191 | — | 100 | 91 | 90 | 87 | 87 | 95 | 91 | 91 | 89 | 86 | 87 |
| 192 | — | — | 100 | 89 | 86 | 87 | 95 | 91 | 91 | 89 | 87 | 86 |
| 193 | — | — | — | 100 | 86 | 85 | 93 | 89 | 89 | 88 | 85 | 85 |
| 194 | — | — | — | — | 100 | 84 | 90 | 87 | 87 | 85 | 84 | 84 |
| 195 | — | — | — | — | — | 100 | 90 | 87 | 87 | 86 | 84 | 84 |
| 196 | — | — | — | — | — | — | 100 | 95 | 95 | 93 | 90 | 90 |
| 197 | — | — | — | — | — | — | — | 100 | 91 | 89 | 87 | 87 |
| 198 | — | — | — | — | — | — | — | — | 100 | 89 | 87 | 86 |
| 199 | — | — | — | — | — | — | — | — | — | 100 | 86 | 86 |
| 200 | — | — | — | — | — | — | — | — | — | — | 100 | 83 |
| 201 | — | — | — | — | — | — | — | — | — | — | — | 100 |

Further recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 43, Variants of polypeptides of SEQ ID NO: 43 having an amino acid sequence being at least 80%, 82%, 84%, 86%, 88%, 90%, 91%, 92%, 93%, 94%, 95%, 96%, 97%, 98%, 99%, or 100% identical SEQ ID NO: 43 are, for example, but not excluding others, polypeptides having an amino acid sequence as shown by SEQ ID NOs: 43, 202, 203, 204, 205 or 206. Polypeptides having an amino acid sequence as shown by SEQ ID NOs: 43, 202, 203, 204, 205, 206 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 43, 202, 203, 204, 205 and/or 206, are preferred embodiments of the invention and are preferably used in the expression cassettes, recombinant organisms, methods and processes described herein. Table 22 shows the % sequence identity of pairwise sequence alignments of SEQ ID NOs: 43, 202, 203, 204, 205 and 206. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 22

| | SEQ ID NO: 43 | SEQ ID NO: 202 | SEQ ID NO: 203 | SEQ ID NO: 204 | SEQ ID NO: 205 | SEQ ID NO: 206 |
|---|---|---|---|---|---|---|
| SEQ ID NO: 43 | 100 | 95 | 95 | 93 | 90 | 90 |
| SEQ ID NO: 202 | — | 100 | 91 | 91 | 87 | 87 |
| SEQ ID NO: 203 | — | — | 100 | 88 | 86 | 87 |
| SEQ ID NO: 204 | — | — | — | 100 | 85 | 86 |
| SEQ ID NO: 205 | — | — | — | — | 100 | 84 |
| SEQ ID NO: 206 | — | — | — | — | — | 100 |

Additional recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 45, Variants of polypeptides of SEQ ID NO: 45 having an amino acid sequence being at least 80%, 82%, 84%, 86%, 88%, 90%, 91%, 92%, 93%, 94%, 95%, 96%, 97%, 98%, 99%, or 100% identical SEQ ID NO: 45 are, for example, but not excluding others, polypeptides having an amino acid sequence as shown by SEQ ID NOs: 45, 207, 208, 209, 210 or 211. Polypeptides having an amino acid sequence as shown by SEQ ID NOs: 45, 207, 208, 209, 210, 211 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 45, 207, 208, 209, 210 and/or 211, are preferred embodiments of the invention and are preferably used in the expression cassettes, recombinant organisms, methods and processes described herein. Table 23 shows the % sequence identity of pairwise sequence alignments of SEQ ID NOs: 45, 207, 208, 209, 210 and 211. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 23

| | SEQ ID NO: 45 | SEQ ID NO: 207 | SEQ ID NO: 208 | SEQ ID NO: 209 | SEQ ID NO: 210 | SEQ ID NO: 211 |
|---|---|---|---|---|---|---|
| SEQ ID NO: 45 | 100 | 95 | 95 | 93 | 90 | 90 |
| SEQ ID NO: 207 | — | 100 | 91 | 89 | 86 | 86 |
| SEQ ID NO: 208 | — | — | 100 | 91 | 86 | 88 |
| SEQ ID NO: 209 | — | — | — | 100 | 85 | 85 |
| SEQ ID NO: 210 | — | — | — | — | 100 | 83 |
| SEQ ID NO: 211 | — | — | — | — | — | 100 |

Further recombinant polynucleotides provided by the invention are recombinant polynucleotides comprising at least one nucleic acid sequence encoding at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NO: 47, Variants of polypeptides of SEQ ID NO: 47 having an amino acid sequence being at least 80%, 82%, 84%, 86%, 88%, 90%, 91%, 92%, 93%, 94%, 95%, 96%, 97%, 98%, 99%, or 100% identical SEQ ID NO: 47 are, for example, but not excluding others, polypeptides having an amino acid sequence as shown by SEQ ID NOs: 47, 212, 213, 214, 215 or 216. Polypeptides having an amino acid sequence as shown by SEQ ID NOs: 47, 212, 213, 214, 215, 216 and polypeptides having an amino acid sequence being at least 80%, 82%, 84%, 86%, 88%, 90%, 91%, 92%, 93%, 94%, 95%, 96%, 97%, 98%, 99%, or 100% identical SEQ ID NO: 47, 212, 213, 214, 215 and/or 216, are preferred embodiments of the invention and are preferably used in the expression cassettes, recombinant organisms, methods and processes described herein. Table 24 shows the % sequence identity of pairwise sequence alignments of SEQ ID NOs: 47, 212, 213, 214, 215 and 216. The parameters used for the pairwise sequence alignments are: Needleman-Wunsch algorithm of the EMBOSS Software Suite, #GAPMETHOD: NOGAPS, #GAPOPEN:10, GAPEXTEND: 0,5, MATRIX: EBLOSUM62

TABLE 24

| | SEQ ID NO: 47 | SEQ ID NO: 212 | SEQ ID NO: 213 | SEQ ID NO: 214 | SEQ ID NO: 215 | SEQ ID NO: 216 |
|---|---|---|---|---|---|---|
| SEQ ID NO: 47 | 100 | 95 | 95 | 93 | 90 | 90 |
| SEQ ID NO: 212 | — | 100 | 92 | 89 | 87 | 86 |
| SEQ ID NO: 213 | — | — | 100 | 89 | 86 | 88 |
| SEQ ID NO: 214 | — | — | — | 100 | 85 | 84 |
| SEQ ID NO: 215 | — | — | — | — | 100 | 84 |
| SEQ ID NO: 216 | — | — | — | — | — | 100 |

A further embodiment of the invention are polynucleotides comprising a nucleic acid sequence comprising at least one or more expression cassettes for at least one, two, three, four, five, six, seven, eight, nine, ten, eleven, twelve, thirteen, fourteen, fifteen, sixteen, seventeen, eighteen, nineteen, twenty, twenty one, or all of the polypeptides described by SEQ ID NOs: 3, 5, 7, 9, 13, 15, 17, 19, 21, 23, 25, 27, 29, 31, 33, 35, 37, 39, 41, 43, 45, and 47, or their variants in sequence identity, in particular polypeptides as described by SEQ ID NO: 89, 105, 142, 158, 169, 180 and 196. An additional embodiment of the invention are polynucleotides comprising a nucleic acid sequence comprising at least one or more expression cassettes for at least one, two, three, four, five, six, seven, eight, nine, ten, eleven, twelve, thirteen, fourteen, fifteen, sixteen, seventeen, eighteen, or all of the polypeptides described by SEQ ID NOs: 7, 9, 13, 15, 17, 19, 21, 23, 25, 27, 29, 31, 33, 35, 37, 39, 41, 43, and 45, or their variants in sequence identity, in particular polypeptides as described by SEQ ID NO: 89, 105, 121, 142, 158, 169, 180 and 196. In one embodiment of the invention the polynucleotide comprises a nucleic acid sequence comprising at least one or more expression cassettes for at least one, two, three, four, five, six, seven, eight, nine, ten, eleven, twelve, thirteen, fourteen or all of the polypeptides described by SEQ ID NOs: 13, 15, 17, 19, 21, 23, 25, 27, 29, 31, 33, 35, 37, 39, and 41, or their variants in sequence identity, in particular polypeptides as described by SEQ ID NO: 89, 105, 121, 142, 158, 169, 180 and 196. In one embodiment of the invention the polynucleotide comprises a nucleic acid sequence comprising at least one or more expression cassettes for at least one, two, three, four, five, six, seven, eight or all of the polypeptides described by SEQ ID NOs: 13, 15, 19, 25, 27, 29, 35, 37 and 41, or their variants in sequence identity, in particular polypeptides as described by SEQ ID NO: 89, 105, 142, 169, 180 and 196. In one embodiment of the invention the polynucleotide comprises a nucleic acid sequence comprising at least one or more expression cassettes for at least one, two, three or all of the polypeptides described by SEQ ID NOs: 13, 15, 37 and 41, or their variants in sequence identity, in particular polypeptides as described by SEQ ID NO: 89, 180 and 196.

In one embodiment of the invention the polynucleotide comprises a nucleic acid sequence comprising at least one or more expression cassettes for at least one, two or all of the polypeptides described by SEQ ID NOs: 17, 21 and 33, or their variants in sequence identity, in particular polypeptides as described by SEQ ID NO: 158. In one embodiment of the invention the polynucleotide comprises a nucleic acid sequence comprising at least one or more expression cassettes for at least one or both of the polypeptides described by SEQ ID NOs: 13 and 15, or their variants in sequence identity, in particular polypeptides as described by SEQ ID NO: 89. In one embodiment of the invention the polynucleotide comprises a nucleic acid sequence comprising at least one or more expression cassettes for at least one or both of the polypeptides described by SEQ ID NOs: 19 and 27 or their variants in sequence identity, in particular polypeptides as described by SEQ ID NO: 105. In one embodiment of the invention the polynucleotide comprises a nucleic acid sequence comprising at least one or more expression cassettes for at least one or both of the polypeptides described by SEQ ID NOs: 29 and 37 or their variants in sequence identity, in particular polypeptides as described by SEQ ID NO: 142, 180. In one embodiment of the invention the polynucleotide comprises a nucleic acid sequence comprising at least one or more expression cassettes for at least one or both of the polypeptides described by SEQ ID NOs: 35 and 41, or their variants in sequence identity, in particular polypeptides as described by SEQ ID NO: 169 and 196.

In one embodiment of the invention the polynucleotide comprises a nucleic acid sequence comprising at least one or more expression cassettes for a polypeptide described by SEQ ID NOs: 13, or its variants in sequence identity. In one embodiment of the invention the polynucleotide comprises a nucleic acid sequence comprising at least one or more expression cassettes for a polypeptide described by SEQ ID NOs: 15, or its variants in sequence identity, in particular polypeptides as described by SEQ ID NO: 89. In one embodiment of the invention the polynucleotide comprises a nucleic acid sequence comprising at least one or more expression cassettes for a polypeptide described by SEQ ID NOs: 25, or its variants in sequence identity. In one embodiment of the invention the polynucleotide comprises a nucleic acid sequence comprising at least one or more expression cassettes for a polypeptide described by SEQ ID NOs: 41, or its variants in sequence identity, in particular polypeptides as described by SEQ ID NO: 196.

Examples for polynucleotides as described above are polynucleotides comprising a nucleic acid sequence comprising at least one expression cassette for at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NOs: 13, 15, 19, 25, 27, 29, 35, 37, 41, 89, 105, 142, 169, 180 or 196. A further example of such polynucleotides are polynucleotides comprising an expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence selected from the group of sequences shown in SEQ ID NOs: 13, 15, 19, 25, 27, 29, 35, 37, 41, 89, 105, 142, 169, 180 and 196 and comprising at least one further expression cassette having an amino acid sequence being at least 80%, 82%, 84%, 86%, 88%, 90%, 91%, 92%, 93%, 94%, 95%, 96%, 97%, 98%, 99%, or 100% identical to an amino acid sequence selected from the group of sequences shown in SEQ ID NOs: 13, 15, 19, 25, 27, 29, 35, 37, 41, 89, 105, 142, 169, 180 and 196. Another example of such polynucleotides are polynucleotide comprising an expression cassette for each one of the polypeptides having an amino acid sequence as shown in SEQ ID NOs: 13, 15, 19, 25, 27, 29, 35, 37, 41, 89, 105, 142, 169, 180 and 196. Further examples for polynucleotides as described above are polynucleotides comprising a nucleic acid sequence comprising at least one expression cassette for at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence selected from the group of sequences shown in SEQ ID NOs: 21, 25, 33, and 158, Other examples are polynucleotides comprising at least one expression cassette for at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence selected from the group of sequences shown in SEQ ID NOs: 21, 25, 33, and 158 and comprising at least one expression cassette for at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence selected from the group of sequences shown in SEQ ID NOs: 21, 25, 33, and 158 Additional examples are polynucleotides comprising at least one expression cassette for at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence shown in SEQ ID NOs: 21, and comprising at least one expression cassette for at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence shown in SEQ ID NOs: 33 or 158. These examples are only meant to illustrate the principle of design of these polynucleotides and should not be interpreted as limiting.

A further embodiment of the invention are polynucleotides comprising a nucleic acid sequence being at least 70%, 72%, 74%, 76%, 78%, 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 1 and comprising at least one expression cassette for at least one, two, three, four, five, six, seven, eight, nine, ten, eleven, twelve, thirteen, fourteen, fifteen, sixteen, seventeen, eighteen, nineteen, twenty, twenty one, or all of the polypeptides described by SEQ ID NOs: 3, 5, 7, 9, 13, 15, 17, 19, 21, 23, 25, 27, 29, 31, 33, 35, 37, 39, 41, 43, 45, and 47, or their variants in sequence identity, preferably the polynucleotides comprise a nucleic acid sequence being at least 70%, 72%, 74%, 76%, 78%, 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 1 and comprise at least one expression cassette each one of the polypeptides described by SEQ ID NOs: 3, 5, 7, 9, 13, 15, 17, 19, 21, 23, 25, 27, 29, 31, 33, 35, 37, 39, 41, 43, 45, and 47 or their variants having at least 80%, 82%, 84%, 86%, 88%, 90%, 91%, 92%, 93%, 94%, 95%, 96%, 97%, 98%, 99% sequence identity. A further embodiment of the invention are polynucleotides comprising a nucleic acid sequence being at least 70%, 72%, 74%, 76%, 78%, 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 1 and comprising at least one expression cassette for at least one, two, three, four, five, six, seven, eight, nine, ten, eleven, twelve, thirteen, fourteen, fifteen, sixteen, seventeen, eighteen, or all of the polypeptides described by SEQ ID NOs: 7, 9, 13, 15, 17, 19, 21, 23, 25, 27, 29, 31, 33, 35, 37, 39, 41, 43, and 45, or their variants in sequence identity, preferably the polynucleotides comprise a nucleic acid sequence being at least 70%, 72%, 74%, 76%, 78%, 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 1 and comprise at least one expression cassette each one of the polypeptides described by SEQ ID NOs: 7, 9, 13, 15, 17, 19, 21, 23, 25, 27, 29, 31, 33, 35, 37, 39, 41, 43, and 45 or their variants having at least 80%, 82%, 84%, 86%, 88%, 90%, 91%, 92%, 93%, 94%, 95%, 96%, 97%, 98%, 99% sequence identity.

Figure 2A:
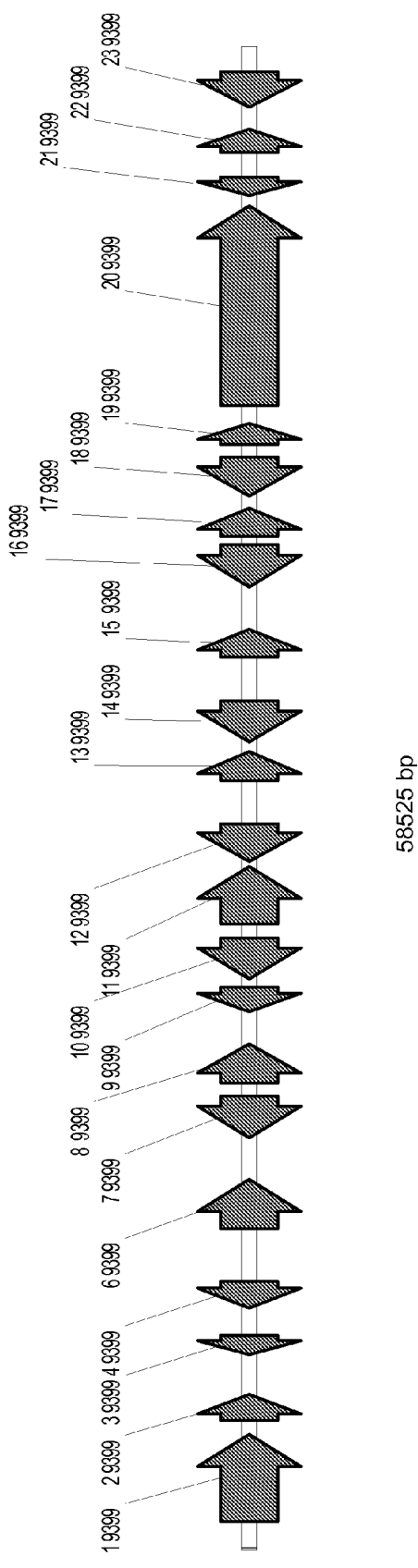
FIG. 2a shows a schematic drawing of a variant of the cornexistin and hydroxycornexistin gene cluster using the same symbols for the open reading frames as described for FIG. 1. This variant has the same length of 58525 base pairs as the cluster depicted in FIG. 1, but the presence of gene 5_9399 is optional. The length of the depicted cluster is not to be understood to represent a fixed length. The length of the depicted cluster may differ in case different (heterologous) promoters or terminators are operatively linked to the depicted open reading frames and/or in case intron sequences are exchanged, modified or deleted. The depicted cluster is also intended to represent cluster variants having a different order of the depicted open reading frames or in which the orientation of one or more open reading frames has been changed. The open reading frames depicted are intended to represent variants of the polypeptides having at least 80% sequence identity to the respective polypeptides encoded in SEQ ID NO: 1, in particular the sequence variants described in Tables 2 to 24.
Figure 2B:
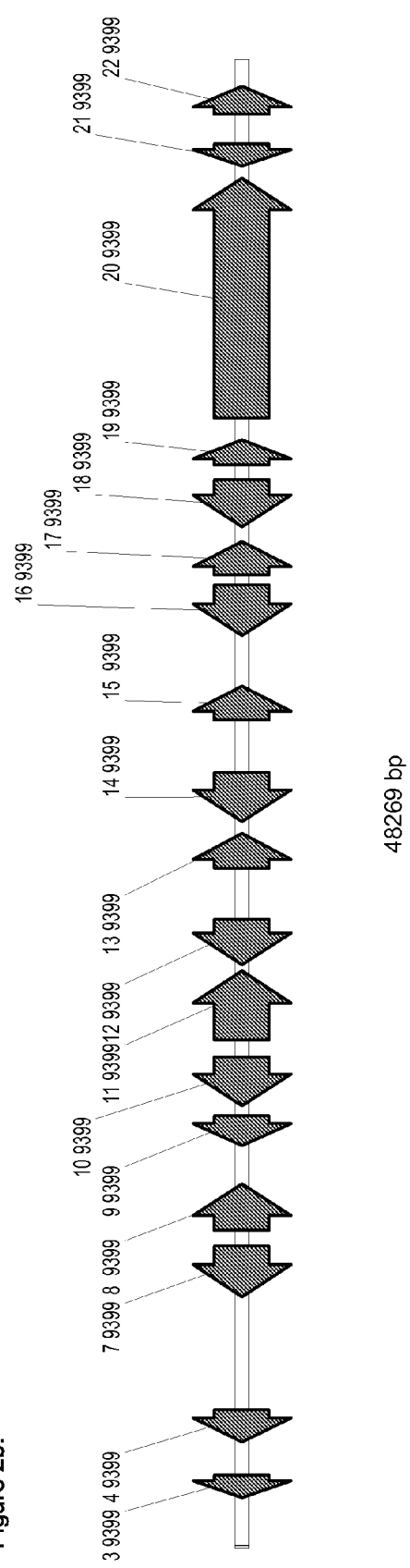
Figure 3A:
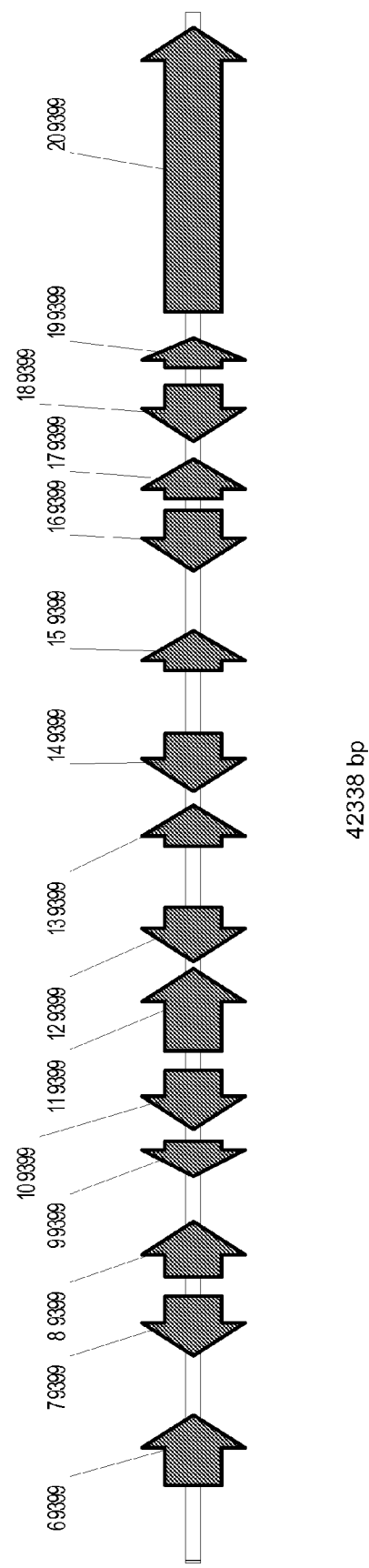
Figure 3B:
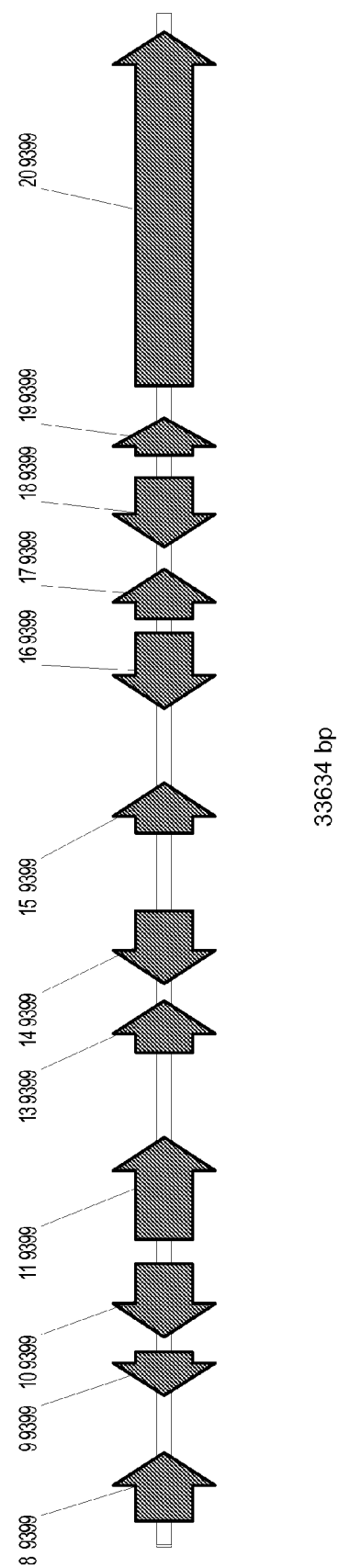

A further embodiment of the invention are polynucleotides comprising a nucleic acid sequence being at least 70%, 72%, 74%, 76%, 78%, 80%, 82%, 84%, 86%, 88%, 90%, 91%, 92%, 93%, 94%, 95%, 96%, 97%, 98%, 99%, or 100% identical to a nucleic acid sequence as shown by the sequence of nucleotide 1001 to nucleotide 57525 of SEQ ID NO: 1 and comprising at least one expression cassette for at least one, two, three, four, five, six, seven, eight, nine, ten, eleven, twelve, thirteen, fourteen, fifteen, sixteen, seventeen, eighteen, nineteen, twenty, twenty one, twenty two or all polypeptides having an amino acid sequence as shown in SEQ ID NOs: 3, 5, 7, 9, 13, 15, 17, 19, 21, 23, 25, 27, 29; 31, 33, 35, 37, 39, 41, 43, 45, or 47, or their variants in sequence identity and sequence length, preferably the polynucleotides comprise a nucleic acid sequence being at least 70%, 72%, 74%, 76%, 78%, 80%, 82%, 84%, 86%, 88%, 90%, 91%, 92%, 93%, 94%, 95%, 96%, 97%, 98%, 99%, or 100% identical to a nucleic acid sequence as shown by the sequence of nucleotide 1001 to nucleotide 57525 of SEQ ID NO: 1 and comprise at least one expression cassette each one of the polypeptides described by SEQ ID NOs: 3, 5, 7, 9, 13, 15, 17, 19, 21, 23, 25, 27, 29; 31, 33, 35, 37, 39, 41, 43, 45, or 47 or their variants having at least 80%, 82%, 84%, 86%, 88%, 90%, 91%, 92%, 93%, 94%, 95%, 96%, 97%, 98%, 99% sequence identity. Another embodiment of the invention are polynucleotides comprising a nucleic acid sequence being at least 70%, 72%, 74%, 76%, 78%, 80%, 82%, 84%, 86%, 88%, 90%, 91%, 92%, 93%, 94%, 95%, 96%, 97%, 98%, 99%, or 100% identical to the nucleic acid sequence as shown by the sequence of nucleotide 12423 to nucleotide 52300 of SEQ ID NO: 1 and comprising at least one expression cassette for at least one, two, three, four, five, six, seven, eight, or all polypeptides having an amino acid sequence as shown in SEQ ID NOs: 13, 15, 19, 25, 27, 29, 35, 37 and 41, or their variants in sequence identity and sequence length, preferably the polynucleotides comprise a nucleic acid sequence being at least 70%, 72%, 74%, 76%, 78%, 80%, 82%, 84%, 86%, 88%, 90%, 91%, 92%, 93%, 94%, 95%, 96%, 97%, 98%, 99%, or 100% identical to a nucleic acid sequence as shown by the sequence of nucleotide 12423 to nucleotide 52300 of SEQ ID NO: 1 and comprise at least one expression cassette each one of the polypeptides described by SEQ ID NOs: SEQ ID NOs: 13, 15, 19, 25, 27, 29, 35, 37 and 41 or their variants having at least 80%, 82%, 84%, 86%, 88%, 90%, 91%, 92%, 93%, 94%, 95%, 96%, 97%, 98%, 99% sequence identity. Preferred emdodiments of these polynucleotides are the polynucleotides depicted in FIGS. 1, 2a, 2b, 3a and 3b Further embodiments of the invention are polynucleotides having a combination of the features of any polynucleotide described above, as well as polynucleotides having a nucleic acid sequence which enables the polynucleotide to hybridize under high stringency hybridisation conditions to any one of these polynucleotides, preferably polynucleotides able to hybridize to a polynucleotide comprising a nucleic acid sequence as shown in SEQ ID NOs: 1, 2, 4, 6, 8, 10, 12, 14, 16, 18, 20, 22, 24, 26, 28, 30, 32, 34, 36, 38, 40, 42, 44 or 46.

It will be understood that the present invention by referring to any of the aforementioned polynucleotides of the invention also refers to complementary or reverse complementary strands of the specific sequences or variants thereof referred to before. The polynucleotide encompasses DNA, including cDNA and genomic DNA, or RNA polynucleotides. However, the present invention also pertains to polynucleotide variants which are derived from the polynucleotides of the present invention and are capable of interfering with the transcription or translation of the polynucleotides of the present invention. Such variant polynucleotides include anti-sense nucleic acids, ribozymes, siRNA molecules, morpholino nucleic acids (phosphorodiamidate morpholino oligos), triple-helix forming oligonucleotides, inhibitory oligonucleotides, or micro RNA molecules all of which shall specifically recognize the polynucleotide of the invention due to the presence of complementary or substantially complementary sequences. These techniques are well known to the skilled artisan. Suitable variant polynucleotides of the aforementioned kind can be readily designed based on the structure of the polynucleotides of this invention. Moreover, comprised are also chemically modified polynucleotides including naturally occurring modified polynucleotides such as glycosylated or methylated polynucleotides or artificial modified ones such as biotinylated polynucleotides.

Another embodiment of the invention are vectors comprising any one of the polynucleotides described above. Preferably, the vector referred to herein is suitable as a cloning vector or transformation vector, i.e. replicable in microbial systems or able to integrate polynucleotides into the genome of a microorganism. Also preferably, the vector of the present invention is an expression vector. Expression vectors comprise expression cassettes which enable the transcription and translation of the polynucleotides in the respective microorganism. The expression cassettes comprise a promoter and a terminator being operably linked to the polynucleotide coding for at least one polypeptide of the invention. The polynucleotides encoding at least one of the polypeptides will preferably be adapted to the codon usage of the respective microorganism. Promoters, terminators and information about codon usage suitable to be used for a particular microorganism are known by a person skilled in the art. Suitable promoters for yeast or fungal species are: ADC1, AOX1r, GAL1, MFα, AC, P-60, CYC1, GAPDH, TEF, rp28, ADH trpC, GAL10, cbh1, hfb2 amyB. Further examples can be taken from Microbiology and Molcular Biology Reviews 70, Pages: 583-ff 2006, or Blumhoff, M et al. "Six novel constitutive promoters for metabolic engineering of *Aspergillus niger*" (2013) APPLIED MICROBIOLOGY AND BIOTECHNOLOGY Vol. 97 Issue: 1 Pages: 259-267.

The expression cassettes may comprise constitutive or inducible promoters. For example, suitable promoters for yeasts, in particular for *Saccharomyces cerevisiae* are for example the Gal1, Gal10, Cup1, Pho5, and Met25 promoters, the trpC, gpdA, tub2 and Tef1 promoters, or the PGI1p, ADH1p, TDH2p, HXT7p, PGK1p, TEF2p, PYK1p, ENO2p, PDC1p, FBA1p, GPDp, GPM1p, TPI1p, TEF1p promoters as being disclosed in Sun et al. "Cloning and characterization of a panel of constitutive promoters for applications in pathway engineering in *Saccharomyces cerevisiae*" (2012); Biotechnology and Bioengineering, Vol. 109, No. 8. Further Promoters and terminators, as well as cloning strategies are described, for example, in Shao et al. (2009) Nucleic Acids Research, Vol. 37, No. 2 e16 (10 pages). In one embodiment of the invention the expression cassettes comprise promoters comprised by SEQ ID NO: 1 or being obtainable from a *Paecilomyces divaricatus* or *Byssochlamys verrucosa* genome.

One example for a promoters being obtainable from a *Paecilomyces divaricatus* genome is a promoter described the nucleic acid sequence of SEQ ID NO: 236. Hence, one embodiment of the invention is a recombinant expression cassette comprising a promoter being operatively linked to a polypeptide encoding polynucleotide, wherein the nucleic acid sequence of the promoter a) is identical to the nucleic acid sequence as shown in SEQ ID NO: 236 or
b) is at least 80%, 82%, 84%, 86%, 88%, 90%, 91%, 92%, 93%, 94%, 95%, 96%, 97%, 98%, 99%, or 100% identical to the nucleic acid sequence as shown in SEQ ID NO: 236, or
c) enables the promoter to hybridize under high stringency hybridization conditions to a polynucleotide comprising a nucleic acid sequence as shown in SEQ ID NO: 236, or
d) is at least 60%, 75% or 80% identical to a nucleic acid sequence as shown in SEQ ID NO: 236 and being obtainable from an expression cassette of a wildtype *Paecilomyces divaricatus* or *Byssochlamys verrucosa* genome, wherein the expression cassette comprises a polynucleotide encoding a polypeptide sequence being at least 90%, 95%, or 100% identical to an amino acid sequence as shown in SEQ ID NO: 238, or
e) is at least 60%, 75% or 80% identical to a nucleic acid sequence as shown in SEQ ID NO: 236 and being obtainable from an expression cassette of a wildtype *Paecilomyces divaricatus* or *Byssochlamys verrucosa* genome, wherein the expression cassette comprises a polynucleotide having a nucleic acid sequence being at least 90%, 95%, or 100% identical to a nucleic acid sequence as shown in SEQ ID NO: 237.

Preferably, the operatively linked polypeptide encoding polynucleotide of such recombinant expression cassette encodes a) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 3, 59, 60, 61, 62 and/or 63, preferably a polypeptide having an amino acid sequence as shown by SEQ ID NOs: 3, 59, 60, 61, 62 or 63 and, or
b) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 5, 64, 65, 66, 67 and/or 68, preferably a polypeptide having an amino acid sequence as shown by SEQ ID NOs: 5, 64, 65, 66, 67 or 68, or
c) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 7, 69, 70, 71, 72 and/or 73, preferably a polypeptide having an amino acid sequence as shown by SEQ ID NOs: 7, 69, 70, 71, 72 or 73, or
d) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 9, 74, 75, 76, 77 and/or 78, preferably a polypeptide having an amino acid sequence as shown by SEQ ID NOs: 9, 74, 75, 76, 77 or 78, or
e) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 13, 79, 80, 81, 82 and/or 83, preferably a polypeptide having an amino acid sequence as shown by SEQ ID NOs: 13, 79, 80, 81, 82 or 83, or
f) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 15, 84, 85, 86, 87, 88, 89, 90, 91, 92, 93 and/or 94, preferably having an amino acid sequence being at least 80%, 82%, 84%, 86%, 88%, 90%, 91%, 92%, more preferred a polypeptide having an amino acid sequence as shown by SEQ ID NOs: 15, 84, 85, 86, 87, 88, 89, 90, 91, 92, 93 or 94, or
g) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 17, 95, 96, 97, 98 and/or 99, preferably a polypeptide having an amino acid sequence as shown by SEQ ID NOs: 17, 95, 96, 97, 98 or 99, or
h) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 19, 100, 101, 102, 103, 104, 105, 106, 107, 108, 109 and/or 110, preferably having an amino acid sequence being at least 80%, 82%, 84%, 86%, 88%, 90%, 91%, 92%, 93%, 94%, 95%, 96%, 97%, 98%, 99%, or 100% identical SEQ ID NO: 105, 106, 107, 108, 109 and/or 110, more preferred having an amino acid sequence being at least 80%, 82%, 84%, 86%, 88%, 90%, 91%, 92%, 93%, 94%, 95%, 96%, 97%, 98%, 99%, or 100% identical SEQ ID NO: 105, even more preferred a polypeptide having an amino acid sequence as shown by SEQ ID NOs: 19, 100, 101, 102, 103, 104, 105, 106, 107, 108, 109 or 110, or
i) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 21, 111, 112, 113, 114 and/or 115, preferably a polypeptide having an amino acid sequence as shown by SEQ ID NOs: 21, 111, 112, 113, 114 or 115, or
j) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 23, 116, 117, 118, 119, 120, 121, 122, 123, 124, 125 and/or 126 preferably 121, 122, 123, 124, 125 and/or 126, more preferred having an amino acid sequence being at least 80%, 82%, 84%, 86%, 88%, 90%, 91%, 92%, 93%, 94%, 95%, 96%, 97%, 98%, 99%, or 100% identical SEQ ID NO: 121, even more preferred a polypeptide having an amino acid sequence as shown by SEQ ID NOs: 23, 116, 117, 118, 119, 120, 121, 122, 123, 124, 125 or 126, or
k) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 25, 127, 128, 129, 130 and/or 131, preferably a polypeptide having an amino acid sequence as shown by SEQ ID NOs: 25, 127, 128, 129, 130 or 131, or
l) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 27, 132, 133, 134, 135 and/or 136, preferably a polypeptide having an amino acid sequence as shown by SEQ ID NOs: 27, 132, 133, 134, 135 or 136, or
m) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 29, 137, 138, 139, 140, 141, 142, 143, 144, 145, 146 and/or 147, preferably having an amino acid sequence being at least 80%, 82%, 84%, 86%, 88%, 90%, 91%, 92%, 93%, 94%, 95%, 96%, 97%, 98%, 99%, or 100% identical SEQ ID NO: 29, 137, 138, 139, 140 and/or 141, more preferred having an amino acid sequence being at least 80%, 82%, 84%, 86%, 88%, 90%, 91%, 92%, 93%, 94%, 95%, 96%, 97%, 98%, 99%, or 100% identical SEQ ID NO: 29, even more preferred a polypeptide having an amino acid sequence as shown by SEQ ID NOs: 29, 137, 138, 139, 140, 141, 142, 143, 144, 145, 146 or 147, or n) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 31, 148, 149, 150, 151 and/or 152, preferably a polypeptide having an amino acid sequence as shown by SEQ ID NOs: 31, 148, 149, 150, 151, or 152, or o) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 33, 153, 154, 155, 156, 157, 158, 159, 160, 161, 162, 163, preferably having an amino acid sequence being at least 80%, 82%, 84%, 86%, 88%, 90%, 91%, 92%, 93%, 94%, 95%, 96%, 97%, 98%, 99%, or 100% identical SEQ ID NO: 158, 159, 160, 161, 162, 163, more preferred having an amino acid sequence being at least 80%, 82%, 84%, 86%, 88%, 90%, 91%, 92%, 93%, 94%, 95%, 96%, 97%, 98%, 99%, or 100% identical SEQ ID NO: 158, even more preferred a polypeptide having an amino acid sequence as shown by SEQ ID NOs: 33, 153, 154, 155, 156, 157, 158, 159, 160, 161, 162 or 163, or p) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 35, 164, 165, 166, 167, 168, 169, 170, 171, 172, 173 and/or 174, preferably having an amino acid sequence being at least 80%, 82%, 84%, 86%, 88%, 90%, 91%, 92%, 93%, 94%, 95%, 96%, 97%, 98%, 99%, or 100% identical SEQ ID NO: 169, 170, 171, 172, 173 and/or 174, more preferred having an amino acid sequence being at least 80%, 82%, 84%, 86%, 88%, 90%, 91%, 92%, 93%, 94%, 95%, 96%, 97%, 98%, 99%, or 100% identical SEQ ID NO: 169, even more preferred a polypeptide having an amino acid sequence as shown by SEQ ID NOs: 35, 164, 165, 166, 167, 168, 169, 170, 171, 172, 173 or 174 or q) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 37, 175, 176, 177, 178, 179, 180, 181, 182, 183, 184 and/or 185, preferabyl having an amino acid sequence being at least 80%, 82%, 84%, 86%, 88%, 90%, 91%, 92%, 93%, 94%, 95%, 96%, 97%, 98%, 99%, or 100% identical SEQ ID NO: 37 and/or 180, more preferred a polypeptide having an amino acid sequence as shown by SEQ ID NOs: 37, 175, 176, 177, 178, 179, 180, 181, 182, 183, 184 or 185, or r) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 39, 186, 187, 188, 189 and/or 190, preferably a polypeptide having an amino acid sequence as shown by SEQ ID NOs: 39, 186, 187, 188, 189 or 190, or s) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 41, 191, 192, 193, 194, 195, 196, 197, 198, 199, 200 and/or 201 preferabyl having an amino acid sequence being at least 80%, 82%, 84%, 86%, 88%, 90%, 91%, 92%, 93%, 94%, 95%, 96%, 97%, 98%, 99%, or 100% identical SEQ ID NO:41 and/or 196, more preferred a polypeptide having an amino acid sequence as shown by SEQ ID NOs: 41, 191, 192, 193, 194, 195, 196, 197, 198, 199, 200 or 201, or t) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 43, 202, 203, 204, 205 and/or 206, preferably a polypeptide having an amino acid sequence as shown by SEQ ID NOs: 43, 202, 203, 204, 205 or 206 and u) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 45, 207, 208, 209, 210 and/or 211, a polypeptide having an amino acid sequence as shown by SEQ ID NOs: 45, 207, 208, 209, 210 or 211, or v) a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 47, 212, 213, 214, 215 and/or 216, preferably a polypeptide having an amino acid sequence as shown by SEQ ID NOs: 47, 212, 213, 214, 215 or 216.

A further embodiment of the invention is a recombinant expression cassette comprising a polynucleotide, comprising a nucleic acid sequence which a) encodes a polypeptide having an amino acid sequence which is at least 90%, 91%, 92%, 93%, 94%, 95%, 96%, 97%, 98%, 99%, or 100% identical to an amino acid sequence as shown in SEQ ID NO: 238 or b) is at least 80%, 82%, 84%, 86%, 88%, 90%, 91%, 92%, 93%, 94%, 95%, 96%, 97%, 98%, 99%, or 100% identical to a nucleic acid sequence as shown in SEQ ID NO: 237, or c) enables a polynucleotide to hybridize under high stringency hybridization conditions to a polynucleotide having a polynuclotide sequence as shown in SEQ ID NO: 237.

It will be clear to a person skilled in the art, that sequences located upstream of starting nucleotides of genes of SEQ ID NO: 1 will be able to provide promoter functions in fungi, in particular in fungi of the genus *Paecilomyces* and the species *Paecilomyces divaricatus*. It will also be clear to a person skilled in the art, that sequences located downstream of end point nucleotides of genes of SEQ ID NO: 1 will be able to provide terminator functions in fungi, in particular in fungi of the genus Paecilomyces and the the species *Paecilomyces divaricatus*. Accordingly, a further embodiment of the invention are fragments of SEQ ID NO: 1 of about 2000, 1750, 1500, 1250, 1000, 750, 500, 300 or 250 nucleotides upstream of a starting nucleotide of each gene of SEQ ID NO: 1 having promoter function in *Paecilomyces divaricatus*, as well as fragments of SEQ ID NO: 1 of about 500, 300, or 250 nucleotides downstream of a endpoint nucleotide of each gene of SEQ ID NO: 1 having terminator function in *Paecilomyces divaricatus*, as well as recombinant expression cassettes, vectors and recombinant microorganisms comprising at least one of these fragments. Accordingly, one embodiment of the invention comprises a recombinant expression cassette comprising a promoter being operatively linked to a polypeptide encoding polynucleotide, wherein the promoter comprises a nucleic acid sequence a) which is identical to at least one of the nucleic acid sequences shown in SEQ ID NO: 217, 218, 219, 220, 221 or 222, or b) which is at least 80%, 82%, 84%, 86%, 88%, 90%, 91%, 92%, 93%, 94%, 95%, 96%, 97%, 98%, 99%, or 100% identical to the nucleic acid sequence as shown in SEQ ID NO: 217, 218, 219, 220, 221 or 222, or c) which hybridizes under stringent conditions to a nucleic acid sequence as shown in any one of SEQ ID NOs: 217, 218, 219, 220, 221 or 222, or d) which is at least 60%, 75% or 80% identical to a nucleic acid sequence as shown in SEQ ID NO: 217, 218, 219, 220, 221 or 222 and being obtainable from an expression cassette of a wildtype *Paecilomyces divaricatus* or *Byssochlamys verrucosa* genome, wherein the expression cassette comprises a polynucleotide encoding a polypeptide comprising an amino acid sequence which is at least 90%, 95%, or 100% identical to an amino acid sequence as shown in SEQ ID NO: 15, 17, 19, 21, 23, 33, 35, 37, 39, 43, 45, 89, 105, 121, 158 or 180, or e) which is at least 60%, 75% or 80% identical to a nucleic acid sequence as shown in SEQ ID NO: 217, 218, 219, 220, 221 or 222 and being obtainable from an expression cassette of a wildtype *Paecilomyces divaricatus* or *Byssochlamys verrucosa* genome, wherein the expression cassette comprises a polynucleotide having a nucleic acid sequence which is at least 90%, 95%, or 100% identical to a nucleic acid sequence as shown in SEQ ID NO: 14, 16, 18, 20, 22, 32, 34, 36, 38, 42, or 44, or f) which is the reverse complement of at least one of a) to e).

Preferred variants of these recombinant expression cassettes encompase expression cassettes comprising a promoter having a nucleic acid sequence, a) which is identical to at least one of the nucleic acid sequences shown in SEQ ID NO: 217 or its reverse complement, or b) which is at least 80%, 82%, 84%, 86%, 88%, 90%, 91%, 92%, 93%, 94%, 95%, 96%, 97%, 98%, 99%, or 100% identical to the nucleic acid sequence as shown in SEQ ID NO: 217 or its reverse complement, or c) which hybridizes under stringent conditions to a nucleic acid sequence as shown in any one of SEQ ID NO: 217 or its reverse complement, or d) which is at least 60%, 75% or 80% identical to a nucleic acid sequence as shown in SEQ ID NO: 217 or its reverse compleent, and being obtainable from an expression cassette of a wildtype *Paecilomyces divaricatus* or *Byssochlamys verrucosa* genome, wherein the expression cassette comprises a polynucleotide encoding a polypeptide comprising an amino acid sequence which is at least 90%, 95%, or 100% identical to an amino acid sequence as shown in SEQ ID NO: 15, 17 and/or 89, or e) which is at least 60%, 75% or 80% identical to a nucleic acid sequence as shown in SEQ ID NO: 217 or its reverse complement and being obtainable from an expression cassette of a wildtype *Paecilomyces divaricatus* or *Byssochlamys verrucosa* genome, wherein the expression cassette comprises a polynucleotide comprising a nucleid acid sequence being at least 90%, 95%, or 100% identical to a nucleic acid sequence as shown in SEQ ID NO: 14 or 16.

Other variants of the recombinant expression cassettes encompase expression cassettes comprising a promoter having a nucleic acid sequence, a) which is identical to at least one of the nucleic acid sequences shown in SEQ ID NO: 218, or b) which is at least 80%, 82%, 84%, 86%, 88%, 90%, 91%, 92%, 93%, 94%, 95%, 96%, 97%, 98%, 99%, or 100% identical to the nucleic acid sequence as shown in SEQ ID NO: 218, or c) which hybridizes under stringent conditions to a nucleic acid sequence as shown in any one of SEQ ID NO: 218, or d) which is at least 60%, 75% or 80% identical to a nucleic acid sequence as shown in SEQ ID NO: 218, and being obtainable from an expression cassette of a wildtype *Paecilomyces divaricatus* or *Byssochlamys verrucosa* genome, wherein the expression cassette comprises a polynucleotide encoding a polypeptide comprising an amino acid sequence which is at least 90%, 95%, or 100% identical to an amino acid sequence as shown in SEQ ID NO: 19, and/or 105 or e) which is at least 60%, 75% or 80% identical to a nucleic acid sequence as shown in SEQ ID NO: 217, 218, 219, 220, 221 or 222 and being obtainable from an expression cassette of a wildtype *Paecilomyces divaricatus* or *Byssochlamys verrucosa* genome, wherein the expression cassette comprises a polynucleotide comprising a nucleic acid sequence which is at least 90%, 95%, or 100% identical to a nucleic acid sequence as shown in SEQ ID NO: 18.

Further variants of the recombinant expression cassettes encompase expression cassettes comprising a promoter having a nucleic acid sequence, a) which is identical to at least one of the nucleic acid sequences shown in SEQ ID NO: 219 or its reverse complement, or b) which is at least 80%, 82%, 84%, 86%, 88%, 90%, 91%, 92%, 93%, 94%, 95%, 96%, 97%, 98%, 99%, or 100% identical to the nucleic acid sequence as shown in SEQ ID NO: 219, or its reverse complement, or c) which hybridizes under stringent conditions to a nucleic acid sequence as shown in any one of SEQ ID NOs: 219, or its reverse complement, or d) which is at least 60%, 75% or 80% identical to a nucleic acid sequence as shown in SEQ ID NO: 219, or its reverse complement and being obtainable from an expression cassette of a wildtype *Paecilomyces divaricatus* or *Byssochlamys verrucosa* genome, wherein the expression cassette comprises a polynucleotide encoding a polypeptide comprising an amino acid sequence which is at least 90%, 95%, or 100% identical to an amino acid sequence as shown in SEQ ID NO: 21, 23 or 121, or e) which is at least 60%, 75% or 80% identical to a nucleic acid sequence as shown in SEQ ID NO: 219, or its reverse complement and being obtainable from an expression cassette of a wildtype *Paecilomyces divaricatus* or *Byssochlamys verrucosa* genome, wherein the expression cassette comprises a polynucleotide comprising a nucleic acide sequence which is at least 90%, 95%, or 100% identical to a nucleic acid sequence as shown in SEQ ID NO: 20 or 22.

Additional variants of the recombinant expression cassettes encompase expression cassettes comprising a promoter having a nucleic acid sequence, a) which is identical to at least one of the nucleic acid sequences shown in SEQ ID NO: 220, or its reverse complement or b) which is at least 80%, 82%, 84%, 86%, 88%, 90%, 91%, 92%, 93%, 94%, 95%, 96%, 97%, 98%, 99%, or 100% identical to the nucleic acid sequence as shown in SEQ ID NO: 220, or its reverse complement, or c) which hybridizes under stringent conditions to a nucleic acid sequence as shown in any one of SEQ ID NOs: 220, or its reverse complement or
d) which is at least 60%, 75% or 80% identical to a nucleic acid sequence as shown in SEQ ID NO: 220, or its reverse complement and being obtainable from an expression cassette of a wildtype *Paecilomyces divaricatus* or *Byssochlamys verrucosa* genome, wherein the expression cassette comprises a polynucleotide encoding a polypeptide comprising an amino acid sequence which is at least 90%, 95%, or 100% identical to an amino acid sequence as shown in SEQ ID NO: 33, 35, 158 or 169, or
e) which is at least 60%, 75% or 80% identical to a nucleic acid sequence as shown in SEQ ID NO: 220, or its reverse complement and being obtainable from an expression cassette of a wildtype *Paecilomyces divaricatus* or *Byssochlamys verrucosa* genome, wherein the expression cassette comprises a polynucleotide comprising a nucleic acid sequence which is at least 90%, 95%, or 100% identical to a nucleic acid sequence as shown in SEQ ID NO: 32 or 34.

Other variants of the recombinant expression cassettes encompase expression cassettes comprising a promoter having a nucleic acid sequence,
a) which is identical to at least one of the nucleic acid sequences shown in SEQ ID NO: 221 or its reverse complement, or
b) which is at least 80%, 82%, 84%, 86%, 88%, 90%, 91%, 92%, 93%, 94%, 95%, 96%, 97%, 98%, 99%, or 100% identical to the nucleic acid sequence as shown in SEQ ID NO: 221 or its reverse complement, or
c) which hybridizes under stringent conditions to a nucleic acid sequence as shown in any one of SEQ ID NOs: 221 or its reverse complement, or
d) which is at least 60%, 75% or 80% identical to a nucleic acid sequence as shown in SEQ ID NO: 221 or its reverse complement and being obtainable from an expression cassette of a wildtype *Paecilomyces divaricatus* or *Byssochlamys verrucosa* genome, wherein the expression cassette comprises a polynucleotide encoding a polypeptide comprising an amino acid sequence which is at least 90%, 95%, or 100% identical to an amino acid sequence as shown in SEQ ID NO: 37, 39 or 180, or
e) which is at least 60%, 75% or 80% identical to a nucleic acid sequence as shown in SEQ ID NO: 221 or its reverse complement and being obtainable from an expression cassette of a wildtype *Paecilomyces divaricatus* or *Byssochlamys verrucosa* genome, wherein the expression cassette comprises a polynucleotide comprising a nucleic acid sequence which is at least 90%, 95%, or 100% identical to a nucleic acid sequence as shown in SEQ ID NO: 36 or 38.

Further variants of the recombinant expression cassettes encompase expression cassettes comprising a promoter having a nucleic acid sequence,
a) which is identical to at least one of the nucleic acid sequences shown in SEQ ID NO: 222 or its reverse complement, or
b) which is at least 80%, 82%, 84%, 86%, 88%, 90%, 91%, 92%, 93%, 94%, 95%, 96%, 97%, 98%, 99%, or 100% identical to the nucleic acid sequence as shown in SEQ ID NO: 222 or its reverse complement, or
c) which hybridizes under stringent conditions to a nucleic acid sequence as shown in any one of SEQ ID NOs: 222 or its reverse complement, or
d) which is at least 60%, 75% or 80% identical to a nucleic acid sequence as shown in SEQ ID NO: 222 or its reverse complement and being obtainable from an expression cassette of a wildtype *Paecilomyces divaricatus* or *Byssochlamys verrucosa* genome, wherein the expression cassette comprises a polynucleotide encoding a polypeptide comprising an amino acid sequence which is at least 90%, 95%, or 100% identical to an amino acid sequence as shown in SEQ ID NO: 43 or 45, or
e) which is at least 60%, 75% or 80% identical to a nucleic acid sequence as shown in SEQ ID NO: 222 or its reverse complement and being obtainable from an expression cassette of a wildtype *Paecilomyces divaricatus* or *Byssochlamys verrucosa* genome, wherein the expression cassette comprises a polynucleotide comprising a nucleid acid sequence which is at least 90%, 95%, or 100% identical to a nucleic acid sequence as shown in SEQ ID NO: 42 or 44.

The expression cassettes comprising a promoter comprsing a nucleic acid sequence being at least 80%, 82%, 84%, 86%, 88%, 90%, 91%, 92%, 93%, 94%, 95%, 96%, 97%, 98%, 99%, or 100% identical to the nucleic acid sequence as shown in at least one of SEQ ID NO: 217, 218, 219, 220, 221 or 222, or being at least 80%, 82%, 84%, 86%, 88%, 90%, 91%, 92%, 93%, 94%, 95%, 96%, 97%, 98%, 99%, or 100% identical to the reverse complement of at least one nucleic acid sequence as shown in SEQ ID NO: 217, 219, 220, 221 or 222, or their variants obtainable from a *Paecilomyces divaricatus* or *Byssochlamys verrucosa* genome as described above can be combined with an expression cassette providing a transcription factor wich activates transcription from these promoters. Such transcription factor is preferably a polypeptide having an amino acid sequence being at least 80%, 82%, 84%, 86%, 88%, 90%, 91%, 92%, 93%, 94%, 95%, 96%, 97%, 98%, 99%, or 100% identical to SEQ ID NO: 25, 127, 128, 129, 130, or 131, preferably having an amino acid sequence being at least 80%, 82%, 84%, 86%, 88%, 90%, 91%, 92%, 93%, 94%, 95%, 96%, 97%, 98%, 99%, or 100% identical to SEQ ID NO: 25.

Hence, the invention also comprises a system for coordinated gene expression in a recombinant microorganism, comprising
I) at least one expression cassette comprising a promoter being able to provide for gene expression in said microorganism and being operably linkted to a polynucleotide encoding a polypeptide having an amino acid sequence which is at least 80%, 82%, 84%, 86%, 88%, 90%, 91%, 92%, 93%, 94%, 95%, 96%, 97%, 98%, 99%, or 100% identical to SEQ ID NO: 25, 127, 128, 129, 130, or 131 and
II) one or more expression cassettes comprising a promoter having a nucleic acid sequence being at least 80%, 82%, 84%, 86%, 88%, 90%, 91%, 92%, 93%, 94%, 95%, 96%, 97%, 98%, 99%, or 100% identical to the nucleic acid sequence as shown in at least one of SEQ ID NO: 217, 218, 219, 220, 221 or 222, or being at least 80%, 82%, 84%, 86%, 88%, 90%, 91%, 92%, 93%, 94%, 95%, 96%, 97%, 98%, 99%, or 100% identical to the reverse complement of at least one nucleic acid sequence as shown in SEQ ID NO: 217, 219, 220, 221 or 222, or their variants obtainable from a *Paecilomyces divaricatus* or *Byssochlamys verrucosa* genome.

The promoter being able to provide for gene expression in said recombinant microorganism can be a promoter providing for constitutive, or growth stage specific, tissue specific or for inducible expression in the recombinant microorganism of interest. Promoters providing for constitutive, growth stage specific, tissue specific or for inducible expression are readily available in the art. A person skilled in the art will be able to select a suitable promoter for a given microorganism. Examples can be taken from Microbiology and Molecular Biology Reviews 70, Pages: 583-ff 2006. Other suitable examples for expression in fungi and yeasts have been provided above. The microorganism is preferably a fungal organism, such as a fungi or a yeast cell, for example of the genus, but not excluding others, *Penicillium, Aspergillus, Paecilomyces, Byssochlamys, Saccaromyces, Pichia, Yarrowia*. Preferably the recombinant microorganism is of the genus *Paecilomyces* or *Byssochlamys*, e.g. of the species *Paecilomyces divaricatus* or *Byssochlamys verrucosa*.

The expression cassettes provided herein can be used in combination with expression vectors. A plurality of suitable expression vectors for different microorganisms are known in the art. These vectors are, for example, in *E. coli*, pLG338, pACYC184, the pBR series such as pBR322, the pUC series such as pUC18 or pUC19, the M113mp series, pKC30, pRep4, pHS1, pHS2, pPLc236, pMBL24, pLG200, pUR290, pIN-III113-B1, lambda-gt11 or pBdCl, in *Streptomyces* pIJ101, pIJ364, pIJ702 or pIJ361, in *Bacillus* pUB110, pC194 or pBD214. Examples of vectors for expression in the yeast *S. cerevisiae* comprise pYep Sec1 (Baldari 1987, Embo J. 6:229-234), pMFa (Kurjan 1982, Cell 30:933-943), pJRY88 (Schultz 1987, Gene 54:113-123) and pYES2 (Invitrogen Corporation, San Diego, Calif.). Further suitable yeast vectors are, for example, pAG-1, YEp6, YEp13 or pEMBLYe23. Vectors and processes for the construction of vectors which are suitable for use in other fungi, such as the filamentous fungi, comprise those which are described in detail in: van den Hondel, C. A. M. J. J., & Punt, P. J. (1991)" Gene transfer systems and vector development for filamentous fungi, in: Applied Molecular Genetics of fungi, J. F. Peberdy et al., Ed., pp. 1-28, Cambridge University Press: Cambridge, or in: More Gene Manipulations in Fungi (J. W. Bennett & L. L. Lasure, Ed., pp. 396-428: Academic Press: San Diego).

The present invention also relates to a method for the production of a polypeptide encoded by a polynucleotide of the present invention comprising
a) cultivating the recombinant microorganism of the present invention under conditions which allow for the production of said polypeptide; and
b) obtaining the polypeptide from the recombinant microorganism of step a).

Suitable conditions which allow for expression of the polynucleotide of the invention depend on the recombinant microorganism as well as the expression control sequence used for governing expression of the polynucleotide. These conditions and how to select them are well known to those skilled in the art. The expressed polypeptide may be obtained, for example, by all conventional purification techniques including affinity chromatography, size exclusion chromatography, high pressure liquid chromatography (HPLC) and precipitation techniques including antibody precipitation. It is to be understood that the method may although preferred -not necessarily yield an essentially pure preparation of the polypeptide. It is to be understood that depending on the recombinant microorganism which is used for the aforementioned method, the polypeptides produced thereby may become posttranslationally modified or processed otherwise. Another group of embodiments of the invention are the polypeptide encoded by a polynucleotide of the present invention or a polypeptide which is obtainable by the aforementioned method of the present invention.

The polynucleotides and vectors of the present invention are particularly suitable for the production of cornexistin and/or hydroxycornexistin in microorganisms, which comprise at least one of the polynucleotides described above in addition to their natural set of genes or polynucleotides. Accordingly, further embodiments of the invention are recombinant microorganisms comprising at least one of the polynucleotides of the invention. This additional polynucleotide can be comprised by a vector or can be integrated in the genome of the microorganism. Such microorganisms can, for example, be used in processes to produce cornexistin and/or hydroxycornexistin.

In one embodiment of the invention, the recombinant microorganism is produced by transforming the microorganism with at least one of the gene clusters described by FIGS. 1, 2a, 2b, 3a and 3b. Preferably the expression cassettes of the gene clusters will comprise promoters and terminator sequences which are functional in the respective microorganism. Preferably also the polynucleotide encoding sequences of the gene clusters will be codon optimized for the respective microorganism. The gene clusters will not need to be transformed as one sigle element, but may be transformed in several pieces, which may or may not integrate at different locations in the genome. Usually all pieces of the gene cluster comprise complete expression cassettes, so that none of the expression cassettes is destroyed in case pieces of the gene cluster are integrated at different locations in the genome of the microorganism.

Preferably, said recombinant microorganism is a bacterium, an actinomycete, a yeast, a fungus, such as an ascomycete, a deuteromycete, or a basidiomycete, preferably the recombinant microorganism is a bacterial cell, a fungi cell or a yeast cell. Preferred bacteria to be used as recombinant microorganisms of the present invention are selected from the group consisting of: *Escherichia coli* and *Bacilus subtilis*. Preferred fungi are selected from the group consisting of: the genus *Paecilomyces*, the genus *Byssochlamys*, the genus *Thermoascus*, the genus *Monascus*, the genus *Aspergillus* and the genus *Penicillium*. In particular preferred are fungi of the species: *Paecilomyces divaricatus, Paecilomyces variotii, Byssochlamys nivea, Byssochlamys verrucosa, Thermoascus aurantiacus, Penicillium chrysogenum, Aspergillus japonicus, Aspergillus niger, Aspergillus nidulans, Aspergillus fumigatus* and *Aspergillus oryzae*. Preferred fungi strains are: *Byssochlamys verrucosa* CBS 605.74, *Paecilomyces divaricatus* CBS 284.48, *Paecilomyces divaricatus* CBS 110429, *Paecilomyces variotii* Bainier SANK 21086, *Thermoascus crustaceus* CBS 117.66, *Thermoascus thermophilus* CBS 624.74, *Aspergillus nidulans* ATCC 11414 or *Aspergillus fumigatus* ATCC 46645, *Aspergillus niger* ATCC 10864 and *Penicillium chrysogenum* ATCC 11500, *Aspergillus oryzae* ATCC 1015, *Aspergillus oryzae* ATCC 42149. Preferred yeasts are seleced from the group consisting of: the genus *Saccharomyces*, the genus *Ashbya*, the genus *Schizosaccharomyces*, the genus *Candida* and the genus *Pichia*. In one embodiment the yeast is *Saccharomyces cerevisiae*. In one a further embodiment, the recombinant microorganism is of the species *Paecilomyces divaricatus*, preferably selected from the group of strains of: *Paecilomyces divaricatus* CBS 284.48, *Paecilomyces divaricatus* CBS 110429, *Paecilomyces variotii* Bainier SANK 21086 In another embodiment, recombinant microorganism is a fungus or yeast, but not of the species *Paecilomyces divaricatus*, preferably, a recombinant microorganism belonging to genus *Penicillium, Aspergillus* or *Saccharomyces*, more preferred belonging to the species: *Penicillium chrysogenum, Aspergillus japonicus, Aspergillus niger, Aspergillus nidulans, Aspergillus fumigatus* and *Aspergillus oryzae*, or *Saccharomyces cerevisiae*.

Accordingly, the invention includes recombinant microorganisms comprising a) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 12, and
b) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 14, and
c) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 16, and
d) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 18, and
e) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 20, and
f) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 22, and
g) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 24, and
h) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 26, and
i) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 28, and
j) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 30, and
k) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 32, and
l) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 34, and
m) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 36, and
n) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 38, and
o) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 40, and
wherein at least one of the expression cassettes of a) to o) is a recombinant expression cassette, preferably at least one of the expression cassettes of b) to o), for example but not excluding others, an expression cassettes of g) comprises a constitutive promoter, even more preferred, at least one of the expression cassettes of a) to o) comprise a promoter comprising a nucleic acid sequence i) which is identical to the nucleic acid sequence as shown in SEQ ID NO: 236 or
ii) which is at least 80%, 82%, 84%, 86%, 88%, 90%, 91%, 92%, 93%, 94%, 95%, 96%, 97%, 98%, 99%, or 100% identical to the nucleic acid sequence as shown in SEQ ID NO: 236, or
iii) which enables the promoter to hybridize under high stringency hybridisation conditions to a polynucleotide comprising a nucleic acid sequence as shown in SEQ ID NO: 236, or
iv) which is at least 60%, 75% or 80% identical to a nucleic acid sequence as shown in SEQ ID NO: 236 and being obtainable from an expression cassette of a wildtype *Paecilomyces divaricatus* or *Byssochlamys verrucosa* genome, wherein the expression cassette comprises a polynucleotide encoding a polypeptide sequence being at least 90%, 95%, or 100% identical to an amino acid sequence as shown in SEQ ID NO: 238, or
v) which is at least 60%, 75% or 80% identical to a nucleic acid sequence as shown in SEQ ID NO: 236 and being obtainable from an expression cassette of a wildtype *Paecilomyces divaricatus* or *Byssochlamys verrucosa* genome, wherein the expression cassette comprises a polynucleotide being at least 90%, 95%, or 100% identical to a nucleic acid sequence as shown in SEQ ID NO: 237.

Preferably, the recombinant microorganism comprise also a) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 6, and
b) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 8, and
c) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 42, and
d) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 44.

In a further embodiment of the invention, the recombinant microorganism comprises also 1) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 2, and
2) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 4, and
3) at least one expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 46.

In some embodiments of the invention, the recombinant microorganism a) does not comprise or has a down-regulated expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 14, or b) does not comprise or has a down-regulated expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 24, or c) does not comprise or has a down-regulated expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 14 and does not comprise or has a down-regulated expression cassette for a polypeptide encoded by a nucleic acid sequence being at least 80%, 82%, 84%, 86%, 88%, 90%, 91%, 92%, 93%, 94%, 95%, 96%, 97%, 98%, 99%, or 100% identical SEQ ID NO: 24.

The invention includes also recombinant microorganisms comprising a) at least one expression cassette for a polypeptide having an amino acid sequence being at least 80%, 82%, 84%, 86%, 88%, 90%, , 91%, 92%, 93%, 94%, 95%, 96%, 97%, 98%, 99%, or 100% identical SEQ ID NO: 13, and b) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 15 or 89, preferably having an amino acid sequence being at least 80%, 82%, 84%, 86%, 88%, 90%, 91%, 92%, 93%, 94%, 95%, 96%, 97%, 98%, 99%, or 100% identical SEQ ID NO: 89, and c) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 17, and d) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 19 and/or 105, preferably having an amino acid sequence being at least 80%, 82%, 84%, 86%, 88%, 90%, 91%, 92%, 93%, 94%, 95%, 96%, 97%, 98%, 99%, or 100% identical SEQ ID NO: 105, and e) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 21, and f) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 23 and/or 121, preferably having an amino acid sequence being at least 80%, 82%, 84%, 86%, 88%, 90%, 91%, 92%, 93%, 94%, 95%, 96%, 97%, 98%, 99%, or 100% identical SEQ ID NO: 121, and g) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 25, and h) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 27, and i) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 29 and/or 141, preferably having an amino acid sequence being at least 80%, 82%, 84%, 86%, 88%, 90%, 91%, 92%, 93%, 94%, 95%, 96%, 97%, 98%, 99%, or 100% identical SEQ ID NO: 29, and j) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 31, and k) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 33 and/or 158, preferably having an amino acid sequence being at least 80%, 82%, 84%, 86%, 88%, 90%, 91%, 92%, 93%, 94%, 95%, 96%, 97%, 98%, 99%, or 100% identical SEQ ID NO: 158, and l) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 35 and/or 169, preferably having an amino acid sequence being at least 80%, 82%, 84%, 86%, 88%, 90%, 91%, 92%, 93%, 94%, 95%, 96%, 97%, 98%, 99%, or 100% identical SEQ ID NO: 169, and m) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 37 and/or 180, and n) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 39, and o) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 41 and/or 196, and wherein at least one of the expression cassettes of a) to o) is a recombinant expression cassette, preferably at least one of the expression cassettes of b) to o), for example but not excluding others, an expression cassette of g) comprises a constitutive promoter, even more preferred, at least one of the expression cassettes of a) to o) comprise a promoter comprising a nucleic acid sequence i) which is identical to the nucleic acid sequence as shown in SEQ ID NO: 236 or ii) which is at least 80%, 82%, 84%, 86%, 88%, 90%, 91%, 92%, 93%, 94%, 95%, 96%, 97%, 98%, 99%, or 100% identical to the nucleic acid sequence as shown in SEQ ID NO: 236, or iii) which enables the promoter to hybridize under high stringency hybridisation conditions to a polynucleotide comprising a nucleic acid sequence as shown in SEQ ID NO: 236, or iv) which is at least 60%, 75% or 80% identical to a nucleic acid sequence as shown in SEQ ID NO: 236 and being obtainable from an expression cassette of a wildtype *Paecilomyces divaricatus* or *Byssochlamys verrucosa* genome, wherein the expression cassette comprises a polynucleotide encoding a polypeptide sequence being at least 90%, 95%, or 100% identical to an amino acid sequence as shown in SEQ ID NO: 238, or v) which is at least 60%, 75% or 80% identical to a nucleic acid sequence as shown in SEQ ID NO: 236 and being obtainable from an expression cassette of a wildtype *Paecilomyces divaricatus* or *Byssochlamys*

*verrucosa* genome, wherein the expression cassette comprises a polynucleotide being at least 90%, 95%, or 100% identical to a nucleic acid sequence as shown in SEQ ID NO: 237.

Preferably, the recombinant microorganism comprise also
a) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 7, and
b) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 9, and
c) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 43, and
d) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 45.

In a further embodiment of the invention, the recombinant microorganism comprises also
a) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 3, and
b) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 5, and
c) at least one expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 47.

Examples of the encoded polypeptides, but not excluding others, are the polypeptides represented by the amino acid sequences cited in Tables 3 to 24.

In some embodiments of the invention, the recombinant microorganism
a) does not comprise or has a down-regulated expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 15 or 89, or
b) does not comprise or has a down-regulated expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 25, or
c) does not comprise or has a down-regulated expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 15 or 89 and does not comprise or has a down-regulated expression cassette for a polypeptide having an amino acid sequence being at least 80%, 82%, 84%, 86%, 88%, 90%, 91%, 92%, 93%, 94%, 95%, 96%, 97%, 98%, 99%, or 100% identical SEQ ID NO: 25.

Another part of the invention is a process to produce a recombinant microorganism comprising the steps of: a) transforming a microorganism with a polynucleotide of the invention or a vector comprising such a polynucleotide; and b) selecting a microorganism comprising said polynucleotide or said vector. A further part of the invention is a process to produce a recombinant microorganism for the production of cornexistin or hydroxycornexistin or the production of cornexistin and hydroxycornexistin comprising the steps of: a) transforming a microorganism with a polynucleotide of the invention or a vector comprising such a polypeptide, b) selecting a microorganism comprising the polynucleotide or the vector, c) selecting a recombinant microorganism of step b) producing cornexistin or hydroxycornexistin or producing cornexistin and hydroxycornexistin. The recombinant microorganisms can be tested for the production of cornexistin or hydroxycornexistin or the production of cornexistin and hydroxycornexistin, by culturing the recombinant microorganism under conditions which allow for the production of cornexistin or hydroxycornexistin or the production of cornexistin and hydroxycornexistin and analysing the recombinant microorganism or the culture medium or analysing the recombinant microorganism and the culture medium for the presence of cornexistin or hydroxycornexistin or the presence of cornexistin and hydroxycornexistin.

In particular preferred polynucleotides used to produce recombinant microorganisms are: Recombinant polynucleotides comprising a nucleic acid sequence being at least 80%, 82%, 84%, 86%, 88%, 90%, 91%, 92%, 93%, 94%, 95%, 96%, 97%, 98%, 99%, or 100% identical to the nucleic acid sequence as shown in SEQ ID NO: 1, or having at least 80%, 82%, 84%, 86%, 88%, 90%, 91%, 92%, 93%, 94%, 95%, 96%, 97%, 98%, 99%, or 100% of the sequence length of the nucleic acid sequence as shown in SEQ ID NO: 1. Recombinant polynucleotides comprising a nucleic acid sequence being at least 70%, 72%, 74%, 76%, 78%, 80%, 82%, 84%, 86%, 88%, 90%, 91%, 92%, 93%, 94%, 95%, 96%, 97%, 98%, 99%, or 100% identical to the nucleic acid sequence as shown by the sequence of nucleotide 12423 to nucleotide 52300 of SEQ ID NO: 1 and comprising at least one expression cassette for at least one, two, three, four, five, six, seven, eight, or all polypeptides having an amino acid sequence as shown in SEQ ID NOs: 13, 15, 19, 25, 27, 29, 35, 37 and 41, or their variants having at least 80%, 82%, 84%, 86%, 88%, 90%, 91%, 92%, 93%, 94%, 95%, 96%, 97%, 98%, or 99% sequence identity, in particular polypeptides as described by SEQ ID NO: 89, 105, 169, 180 and 196. Recombinant polynucleotides comprising a nucleic acid sequence comprising at least one or more expression cassettes for at least one, two, three, four, five, six, seven, eight or all of the polypeptides described by SEQ ID NOs: 13, 15, 19, 25, 27, 29, 35, 37 and 41, or their variants having at least 80%, 82%, 84%, 86%, 88%, 90%, 91%, 92%, 93%, 94%, 95%, 96%, 97%, 98%, or 99% sequence identity, in particular polypeptides as described by SEQ ID NO: 89, 105, 142, 169, 180 and 196. Recombinant polynucleotides comprising a nucleic acid sequence comprising at least one or more expression cassettes for at least one, two or all of the polypeptides described by SEQ ID NOs: 17, 21 and 33, or their variants having at least 80%, 82%, 84%, 86%, 88%, 90%, 91%, 92%, 93%, 94%, 95%, 96%, 97%, 98%, or 99% sequence identity, in particular polypeptides as described by SEQ ID NO: 158. Recombinant polynucleotides comprising a nucleic acid sequence comprising at least one expression cassette for a polypeptide described by SEQ ID NOs: 21, or its variants having at least 80%, 82%, 84%, 86%, 88%, 90%, 91%, 92%, 93%, 94%, 95%, 96%, 97%, 98%, or 99% sequence identity, or comprising at least one expression cassette for a polypeptide described by SEQ ID NOs: 33, or its variants having at least 80%, 82%, 84%, 86%, 88%, 90%, 91%, 92%, 93%, 94%, 95%, 96%, 97%, 98%, or 99% sequence identity, in particular a polypeptide as described by SEQ ID NO: 158, or comprising at least one expression cassette for a polypeptide described by SEQ ID NOs: 21, or its variants having at least 80%, 82%, 84%, 86%, 88%, 90%, 91%, 92%, 93%, 94%, 95%, 96%, 97%, 98%, or 99% sequence identity, and comprising at least one expression cassette for a polypeptide described by SEQ ID NOs: 33, or its variants having at least 80%, 82%, 84%, 86%, 88%, 90%, 91%, 92%, 93%, 94%, 95%, 96%, 97%, 98%, or 99% sequence identity, in particular a polypeptide as described by SEQ ID NO: 158. Recombinant polynucleotides comprising a nucleic acid sequence comprising at least one or more expression cassettes for at least one or both of the polypeptides described by SEQ ID NOs: 13 and 15, or their variants having at least 80%, 82%, 84%, 86%, 88%, 90%, 91%, 92%, 93%, 94%, 95%, 96%, 97%, 98%, or 99% sequence identity, in particular polypeptides as described by SEQ ID NO: 89. Recombinant polynucleotides comprising a nucleic acid sequence comprising at least one or more expression cassettes for at least one or both of the polypeptides described by SEQ ID NOs: 19 and 27, or their variants having at least 80%, 82%, 84%, 86%, 88%, 90%, 91%, 92%, 93%, 94%, 95%, 96%, 97%, 98%, or 99% sequence identity, in particular polypeptides as described by SEQ ID NO: 105. Recombinant polynucleotides comprising a nucleic acid sequence comprising at least one or more expression cassettes for at least one or both of the polypeptides described by SEQ ID NOs: 29 and 37or their variants having at least 80%, 82%, 84%, 86%, 88%, 90%, 91%, 92%, 93%, 94%, 95%, 96%, 97%, 98%, or 99% sequence identity, in particular polypeptides as described by SEQ ID NO: 142 and 180. Recombinant polynucleotides comprising a nucleic acid sequence comprising at least one or more expression cassettes for at least one or both of the polypeptides described by SEQ ID NOs: 35 and 41, or their variants having at least 80%, 82%, 84%, 86%, 88%, 90%, 91%, 92%, 93%, 94%, 95%, 96%, 97%, 98%, or 99% sequence identity and sequence length, in particular polypeptides as described by SEQ ID NO: 169 and 196. Recombinant polynucleotides comprising a nucleic acid sequence comprising at least one or more expression cassettes for a polypeptide described by SEQ ID NOs: 13, or its variants having at least 80%, 82%, 84%, 86%, 88%, 90%, 91%, 92%, 93%, 94%, 95%, 96%, 97%, 98%, or 99% sequence identity. Recombinant polynucleotides comprising a nucleic acid sequence comprising at least one or more expression cassettes for a polypeptide described by SEQ ID NOs: 15, or its variants having at least 80%, 82%, 84%, 86%, 88%, 90%, 91%, 92%, 93%, 94%, 95%, 96%, 97%, 98%, or 99% sequence identity and sequence length, in particular polypeptides as described by SEQ ID NO: 89. Recombinant polynucleotides comprising a nucleic acid sequence comprising at least one or more expression cassettes for a polypeptide described by SEQ ID NOs: 25, or its variants having at least 80%, 82%, 84%, 86%, 88%, 90%, 91%, 92%, 93%, 94%, 95%, 96%, 97%, 98%, or 99% sequence identity. Recombinant polynucleotides comprising a nucleic acid sequence comprising at least one or more expression cassettes for a polypeptide described by SEQ ID NOs: 41, or its variants having at least 80%, 82%, 84%, 86%, 88%, 90%, 91%, 92%, 93%, 94%, 95%, 96%, 97%, 98%, or 99% sequence identity and sequence length, in particular polypeptides as described by SEQ ID NO: 196.

Methods to test for the presence of cornexistin or hydroxycornexistin are known in the art.

Examples for such methods are disclosed in U.S. Pat. No. 4,897,104, U.S. Pat. No. 4,990,178 and U.S. Pat. No. 5,424,278.

The present invention provides also for a process for the production of cornexistin or hydroxycornexistin or the production of cornexistin and hydroxycornexistin comprising the steps of: a) cultivating the recombinant microorganism comprising at least one polynucleotide of the invention under conditions which allow for the production of cornexistin or hydroxycornexistin or cornexistin and hydroxycornexistin by said recombinant microorganism; and b) obtaining produced cornexistin or produced hydroxycornexistin or obtaining produced cornexistin and hydroxycornexistin. Preferably cornexistin or hydroxycornexistin or cornexistin and hydroxycornexistin are obtained from the culture broth.

The produced cornexistin or hydroxycornexistin or the produced cornexistin and hydroxycornexistin can be obtained directly, or can be converted to their dibasic acid form and obtained as salts, preferably as agriculturally acceptable salts.

Accordingly, the present invention also encompasses a process for the production of the free dibasic acid of cornexistin or of agriculturally acceptable salts of cornexistin, comprising the steps of: a) cultivating the recombinant microorganism comprising at least one polynucleotide of the invention under conditions which allow for the production of cornexistin, and b) obtaining produced cornexistin and producing the dibasic acid of cornexistin or producing agriculturally acceptable salts of the dibasic acid of cornexistin. Alternatively, a process for the production of the free dibasic acid of cornexistin or of agriculturally acceptable salts of cornexistin, comprises the steps of: a) cultivating the recombinant microorganism comprising at least one polynucleotide of the invention under conditions which allow for the production of cornexistin, b) producing the dibasic acid of cornexistin or producing agriculturally acceptable salts of the dibasic acid of cornexistin and c) obtaining the dibasic acid of cornexistin or obtaining agriculturally acceptable salts of the dibasic acid of cornexistin. A further embodiment of the invention is a process for the production of the free dibasic acid of hydroxycornexistin or of agriculturally acceptable salts of hydroxycornexistin, comprising the steps of: a) cultivating the recombinant microorganism comprising at least one polynucleotide of the invention under conditions which allow for the production of hydroxycornexistin, and b) obtaining produced hydroxycornexistin and producing the dibasic acid of hydroxycornexistin or producing agriculturally acceptable salts of the dibasic acid of hydroxycornexistin. Alternatively, process for the production of the free dibasic acid of hydroxycornexistin or of agriculturally acceptable salts of hydroxycornexistin, comprises the steps of: a) cultivating the recombinant microorganism comprising at least one polynucleotide of the invention under conditions which allow for the production of hydroxycornexistin, b) producing the dibasic acid of hydroxycornexistin or producing agriculturally acceptable salts of the dibasic acid of hydroxycornexistin and c) obtaining the dibasic acid of hydroxycornexistin or obtaining agriculturally acceptable salts of the dibasic acid of hydroxycornexistin.

Methods to produce the dibasic acid of cornexistin and agriculturally acceptable salts of cornexistin are known in the art and, for example, disclosed in U.S. Pat. Nos. 4,897,104 and 4,990,178, which are included herein by reference in their entirety.

The term "cultivating" as used herein refers maintaining and growing the recombinant microorganisms under culture conditions which allow the cells to produce cornexistin and/or hydroxycornexistin. This implies that the polynucleotide of the present invention is expressed in the recombinant microorganism so that the polypeptide(s) encoded by the at least one nucleic acid sequence is present in the recombinant microorganism in a biologically active form. Suitable culture conditions for cultivating the recombinant microorganism are described in more detail in the accompanying Examples below and are known in the art. Preferably the culturing conditions are adapted to the preferred culturing condigions of the respective species of the recombinant microorganism. In particular, recombinant microorganisms of the present invention can be cultured using, for example, glucose, sucrose, honey, dextrin, starch, glycerol, molasses, animal or vegetable oils and the like as the carbon source for the culture medium. Potato flakes are preferably added to the growth medium in case the recombinant microorganism uses promoter sequences comprised by SEQ ID NO: 1 to express the polypeptide(s) endcoded by SEQ ID NO: 1 and does not comprise an expression cassette for expression of the polypeptide of SEQ ID NO: 25, or its variants, under control of a heterologous promoter, preferably an constitutive promoter. Furthermore, soybean flour, wheat germ, corn steep liquor, cotton seed waste, meat extract, polypeptone, malt extract, yeast extract, ammonium sulfate, sodium nitrate, urea and the like can be used for the nitrogen source. The addition of inorganic salts which can produce sodium, potassium, calcium, magnesium, cobalt, chlorine, phosphoric acid (di-potassium hydrogen phosphate and the like), sulfuric acid (magnesium sulfate and the like) and other ions as required is also effective. Furthermore, various vitamins such as thiamine (thiamine hydrochloride and the like), amino acids such as glutamine (sodium glutamate and the like), asparagine (DL-asparagine and the like), trace nutrients such as nucleotides and the like, and selection drugs such as antibiotics and the like can also be added as required. Moreover, organic substances and inorganic substances can be added appropriately to assist the growth of the microorganism and promote the production of cornexistin and hydroxycornexistin or the precursor thereof. The pH of the culture medium is, for example, of the order of pH 4.5 to pH 8. The culturing can be carried out with a method such as the solid culturing method under aerobic conditions, the concussion culturing method, the air-passing agitation culturing method or the deep aerobic culturing method, but the deep aerobic culturing method is the most suitable. The appropriate temperature for culturing is from 15° C. to 40° C., but in many cases growth occurs in the range from 20° C. to 30° C. However, the genus Paecilomyces and Byssochlamys comprise mesophilic, thermotolerant and thermophilic species which can be grown at much higher temperatures. The production of cornexistin and hydroxycornexistin or its precursors differs according to the culture medium and culturing conditions, or the host which is being used, but with any culturing method the accumulation of cornexistin and hydroxycornexistin reaches a maximum generally in from 5 to 20 days. The culturing is stopped when the amount of cornexistin and hydroxycornexistin or its precursor in the culture reaches its highest level and the target material is isolated from the culture and refined for isolating cornexistin and hydroxycornexistin or a precursor thereof from the culture material. Examples for such conditions which allow for the production of cornexistin and hydroxycornexistin are disclosed in U.S. Pat. Nos. 4,897,104, 4,990,178 and 5,424,278 which are included herein by reference in their entirety.

The term "obtaining" as used herein encompasses the provision of the cell culture including the recombinant microorganisms and the culture medium as well as the provision of purified or partially purified preparations thereof comprising the cornexistin and hydroxycornexistin or a precursor thereof, preferably, in free form. More details on purification techniques can be found elsewhere herein below. The usual methods of extraction and refinement which are generally used in these circumstances, such as methods of isolation such as solvent extraction, methods involving ion exchange resins, adsorption or partition chromatography, gel filtration, dialysis, precipitation, crystallization and the like can be used either individually or in appropriate combinations. In particular, cornexistin and hydroxycornexistin can be isolated from a cornexistin and hydroxycornexistin containing medium or lysate using a known method for isolating cornexistin and hydroxycornexistin. Preferably, the process for isolation disclosed by Furuta 1982, Agricultural and Biological Chemistry (1982), 46(7), 1921-2 is envisaged in accordance with the method of the present invention. Examples for methods which allow to obtain cornexistin and hydroxycornexistin, their dibasic forms or their agriculturally acceptable salts are disclosed in U.S. Pat. Nos. 4,897,104, 4,990,178 and 5,424,278 which are included herein by reference in their entirety.

Further methods of the invention include a method to enhance the production of cornexistin or hydroxycornexistin or cornexistin and hydroxycornexistin in *Paecilomyces divaricatus* or *Byssochlamys verrucosa* by upregulating the activity of at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NOs: 13, 15, 19, 25, 27, 29, 35, 37, 41, 89, 105, 142, 169, 180 and 196. Further methods of the invention include a method to enhance the production of cornexistin or hydroxycornexistin or cornexistin and hydroxycornexistin in *Paecilomyces divaricatus* or *Byssochlamys verrucosa* by upregulating the activity of at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NOs: 21, 25, 33 or 158 preferably upregulating the activity of at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NOs: 21, 25 or 158.

In one embodiment of the invention, the upregulated activity is the activity of at least one polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NOs: 13, 15, 25, 35, 41, 89, 169 and 196.

A further method is a method to enhance the production of hydroxycornexistin in *Paecilomyces divaricatus* or *Byssochlamys verrucosa* by upregulating the activity of a polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NOs: 15 or 89. Another method of the invention is a method to enhance the production of cornexistin in *Paecilomyces divaricatus* or *Byssochlamys verrucosa* by downregulating the activity of a polypeptide having an amino acid sequence being at least 80%, 82%, 84%, 86%, 88%, 90%, 91%, 92%, 93%, 94%, 95%, 96%, 97%, 98%, 99%, or 100% identical to an amino acid sequence as shown in SEQ ID NOs: 15 or 89.

The polynucleotides provided by the invention also allow to identify microorganisms being capable to produce cornexistin or hydroxycornexistin or being capable to produce cornexistin and hydroxycornexistin. Accordingly, the invention encompasses a method to identify microorganisms capable to produce cornexistin or hydroxycornexistin or capable to produce cornexistin and hydroxycornexistin comprising the steps of: a) providing genomic DNA or cDNA of a microorganism or of a recombinant microorganism and; b) testing the genomic DNA or cDNA for the presence of at least one polynucleotide of the invention.

Finally, encompassed by the present invention is the use of the polynucleotide, the vector or the recombinant microorganism of the invention, in general, for the production of cornexistin and hydroxycornexistin in any of the methods disclosed herein.

All references cited in this specification are herewith incorporated by reference with respect to their entire disclosure content and the disclosure content specifically mentioned in this specification.

EXAMPLES

To isolate and clone the cornexistin and hydroxycornexistin gene cluster the transformation-associated recombination (TAR) cloning in the yeast *Saccharomyces cerevisiae* is used. This method is based on in vivo recombination between genomic DNA and a linearized TAR cloning vector containing the respective targeting sequences homologous to the region of interest (described in the following as hooks). The method is described in the publications such as Larionov et al. 1996, Proc. Natl. Acad. Sci. USA 93: 491-496 and Kouprina and Larionov 2008 (Kouprina and Larionov 2008, Nature Protocols 3: 371-377). The cloning of the cluster is done as described by Kouprina and Larionov 2008 below (Kouprina and Larionov 2008, Nature Protocols 3: 371-377):

Example 1

Sequencing of Genomic DNA of *Paecilomyces divaricatus* SANK 21086

Chromosomal DNA of the fungal strain SANK 21086 was isolated using the DNAeasy kit from Qiagen according to the protocol. The DNA was subjected to DNA sequencing and the resulting sequences were assembled and ordered to contig sequences. Contig sequences were analysed for orfs and resulting proteins by intron and exon identification. Annotation was performed and orfs were named. The gene cluster for cornexistin and hydroxycornexistin is identified by genome analysis and functional characteristics of the contained enzymatic activities of the respective proteins for which the DNA codes.

Example 2

Construction of the TAR Cloning Vector p9399

The plasmid is generated based on the yeast-*E. coli* shuttle vector pVC-604, being available via the American Type Culture Collection ATCC No.: MBA-212 and containing a yeast selectable marker (HIS3) and a yeast centromeric sequence (CEN6). Plasmid pVC-604 is digested with BamHI to integrate the first hook (SEQ ID NO: 56) representing 300 by homologous sequences to the 5' flanking region of the cornexistin/hydroxycornexistin cluster. The DNA fragment with the SEQ ID NO: 56 is PCR amplified, purified and ligated in the corresponding BamHI site of pVC-604. In the same way, the second hook (SEQ ID NO: 57) containing 300 bp of the 3'-flanking region of the cornexistin/hydroxycornexistin cluster is PCR amplified and ligated into the EcoRI restriction site to generate plasmid p9399. This plasmid is isolated in high amounts using the DNA Maxi Kit (Qiagen) and 5 µg plasmid-DNA are linearized by SmaI and purified by gel extraction. The linearized plasmid is used subsequently in the TAR cloning experiment.

Example 3

Preparation of Genomic DNA

The genomic DNA of *Paecilomyces divaricatus* SANK 21086 for the TAR cloning experiment is isolated using the ZR Fungal/Bacterial DNA MiniPrep (Zymo Research) according to the protocol of the supplier.

Example 4

Preparation of Competent Yeast Spheroplasts

One day before the TAR cloning experiment, 50 ml YEPD medium (2% glucose, 1% bacto yeast extract, 2% bacto peptone, 80 mg/l adenine hemisulfate) is inoculated with yeast strain VL6-48, being available via the American Type Culture Collection ATCC No.: MYA-3666, and incubated overnight at 30° C. until OD660 of 3.0-5.0 is achieved. The yeast cells are harvested by centrifugation for 5 min at 1000 g and 5° C., washed in 30 ml of sterile water and resuspended in 20 ml of 1 M sorbitol. After centrifugation for 5 min at 1000 g and 5° C. the cell pellet is resuspended in 20 ml of SPE solution (1 M sorbitol, 0.01 M $Na_2HPO_4$ 0.01 M $Na_2EDTA$, pH 7.5). Subsequently, 20 µl of zymolyase solution (10 mg/ml zymolyase 20 T in 25% (w/v) glycerol) and 40 µl of ME are added and incubated at 30° C. for 20 min with slow shaking. The spheroplasts are centrifuged for 10 min at 570 g at 5° C. and the pellet is resuspended in 50 ml 1 M sorbitol. After repeating the washing step, the final pellet is gently dissolved in 2 ml of STC solution (1 M sorbitol, 0.01 M Tris-HCl, 0.01 M $CaCl_2$, pH 7.5).

Example 5

Transformation of Spheroplasts by Genomic DNA Along with the TAR Vector p9399

200 µl of the spheroplast suspension is mixed with 2-3 µg of genomic DNA and 1 µg of the linearized p9399 vector and incubate for 10 min at room temperature. 800 µl of PEG8000 solution (20% PEG8000, 10 mM $CaCl_2$, 10 mM Tris-HCl, pH 7.5) is added and the sample is incubated for 10 min at room temperature. After centrifugation for 5 min at 300-500 g at 5° C., the spheroplasts are resuspended in 800 µl of SOS solution (1 M sorbitol, 6.5 mM $CaCl_2$, 0.25% yeast extract, 0.5% peptone) and incubated for 40 min at 30° C. without shaking. The spheroplasts are transferred into a tube containing 7 ml of melted SORB-TOP-His selection medium (1 M sorbitol, 2% D-glucose, 0.17% yeast nitrogen base, 0.5% $(NH_4)_2SO_4$ and 3% bacto agar containing the following supplements: 0.006% adenine sulfate, 0.006% uracil, 0.005% L-arginine.HCl, 0.008% L-aspartic acid, 0.01% L-glutamic acid, 0.005% L-isoleucine, 0.01% L-leucine, 0.012% L-lysine.HCl, 0.002% L-methionine, 0.005% L-phenylalanine, 0.0375% L-serine, 0.01% L-threonine, 0.005% L-tryptophan, 0.005% L-tyrosine and 0.015% L-valine) gently mixed and quickly poured onto SORB-His plates with selective medium. The plates are incubated for 5-7 days at 30° C. until transformants become visible.

Example 6

Identification of Gene-positive Pools 300 primary transformants are transferred by toothpicks onto SD-His plates (2% D-glucose, 0.17% yeast nitrogen base, 0.5% $(NH_4)_2SO_4$, 2% bacto agar supplemented as described in SORB-TOP-His), 30 colonies are plated onto each master plate, and incubated at 30° C. for 2-3 days. Replica plates of each master plate are performed and the master plate is used for detection of gene-positive pools. The yeast cells from each master plate are washed out with 5 ml of water and the cells are pelleted by centrifugation for 5 min at 1000 g at 5° C. The cell pellet is resuspended in 1 ml of 1 M sorbitol solution, centrifuged for 30 s at 2000 g at room temperature and again resuspended in 0.5 ml of SPE solution containing ME (1/1000 dilution). After adding 20 µl of zymolyase solution, each sample is incubated for 2 h at 30° C. The spheroplasts are harvested by centrifugation for 5 min at 2000 g at room temperature and are resuspended in 0.5 ml of EDTA. Lysing of spheroplasts is induced by adding 1 µl of diethylpyrocarbonate and incubation at 70° C. for 15 min. After adding of 50 µl of 5 M KAc solution the tubes are incubated for 30 min on ice. The precipitate is pelleted by centrifugation for 15 min at maximum speed (16,000 g) at room temperature and the supernatant is transferred to a fresh tube. The DNA is extracted by ethanol at room temperature and the pelleted by centrifugation for 5 min at maximum speed (16,000 g) at room temperature. The pellet is resuspended in 0.4 ml of water. After washing in 0.5 ml of isopropanol the final pellet is dissolved in 0.3 ml of water.

1 µl of the DNA solution is used in 50 µl PCR with two diagnostic primer pairs P1f: 5'-GGAATAAGCAGGAATG-GTTC-3'; (Seq ID NO: 48) P1r: 5'-CGCATCCATTCTG-GAGAAAC-3'; (SEQ ID NO: 49), P2f: 5'-CGCTG-GATCTCGGCGTTATC-3' (SEQ ID NO: 50), P2r: 5'-GCTGAGCTATCTTCTCCGACAAC-3') (SEQ ID NO: 51) to identify gene-positive pools. The PCR is done according to the Taq polymerase manufacturer's protocols. Using both primer pairs, gene-positive pools show an amplicon of 502 bp and 558 bp, respectively.

Example 7

Identification and Analysis of Individual Gene-positive Clones in Pools

Each transformant from replica plates with positive pools is added into 100 µl mixture of 80 ml water, 20 µl zymolyase solution and 1 µl of ME and incubated for 1 h at 30° C. After adding 10 µl of 2% SDS solution and another 15 min incubation at 70° C., 10 µl of 5 M KAc solution is added and the samples are left on ice for 15 min. After centrifugation, the supernatant is transferred to a new tube and an equal amount of isopropanol is added. The sample is precipitated and the final pellet is dissolved in 30 µl of water. 1 µl of the DNA solution is used in 50 µl PCR with the above mentioned diagnostic primer pairs. The PCR is done according to the Taq polymerase manufacturer's protocols. Yeast recombinants that produced PCR amplicons of correct size are grown overnight at 30° C. and 225 rpm in 2 ml of SD-His media. The DNA is isolated using the ChargeSwitch (Invitrogen) Nucleic Acid Purification Technology and transformed in E. coli electrocompetent cells to amplify the cloned DNA (Kim et al. 2010 Biopolymers 93: 833-844).

Clones containing the gene cluster described by SEQ ID NO: 1 are identified as described above leading to the plasmid p9399_Co1, DNA from the strain containing p9399_Co1 is subsequently prepared for transformation purposes.

Example 8

Co-transformation of p9399_Co1 and the nat1 Resistance Marker

Paecilomyces divaricatus SANK 21086 is co-transformed with the cloned Cornexistin/hydroxycornexistin cluster plasmid pPtrpC-Pcnat1 (SEQ ID NO: 58). The plasmid contains the codon-optimized nat1 resistance marker gene to select positive Paecilomyces divaricatus transformants. Cotransformation can be done according to the protocol described in WO12116935. In addition, fungal conidiospores can be transformed too Clones harboring the nat1 resistance marker gene as well as the recombinant plasmid p9399_Co1 containing the gene cluster coding for the enzymes of the Cornexistin/hydroxycornexistin biosynthesis are identified by isolating genomic DNA and performing PCR using the primers
SEQ ID NO: 52 (5'-CGACGGCCAGTGAATTGTAATAC-3') and
SEQ ID NO: 53 (5'-GGAGGTAACCCACCTTTCTG-3') or
SEQ ID NO: 54 (5'-GAGCCACCTTTCCCAGAATG-3') and
SEQ ID NO: 55 (5'-GCTCCTATGTTGTGTGGAATTG-3').

Positive clones show bands of 711 bp and 703 bp, respectively.

Example 9

Production of Cornexistin/Hydroxycornexistin using SANK 21086 p9399_Co1

A transformant SANK 21086 p9399_Co1 is grown in an erlenmayer shake flask without baffles containing the following medium: 5% Potato flakes, 5% Glycerol, 0.4% Urea, pH 6 and at 220 rpm in a rotary shaker with an amplitude of 4 cm. After 336 h of incubation at 26° C. cultures are harvested by centrifugation (10000 g 20 min). Cornexistin as well as hydroxycornexistin are isolated from the broth.

Centrifuge culture for 10' @ 4000 rpm
Transfer 10 mL of supernatant to a 50 mL Falcon Tube and acidify with 2M $H_2SO_4$ to pH 2.5
Take the acidified supernatant and add 10 mL ethyl acetate, transfer to 50 mL Falckon tube
Seal Falcon tube with Parafilm and put horizontally in a box
Shake box with Falcon tubes for 20' @ 220 rpm
Centrifuge for 10' @ 4000 rpm
Evaporate 300 µL ethyl acetate extract (upper organic phase) by vacuum centrifugation
Add 300 µL acetonitrile
Shake for 10' @ 1200 rpm @ RT to dissolve the pellet
Filtrate through 0.22 µm sterile filter
Transfer into HPLC vial and analyze via reversed phase HPLC as described below
The cornexistin concentration is determined by HPLC analysis as described below:

TABLE 25

Results of Example 9:

| Strain | Productivity of cornexistin | Productivity of hydroxycornexistin |
|---|---|---|
| SANK 21086 | + | + |
| SANK 21086 pPtrpC-Pcnat1 | + | + |
| SANK 21086, p9399_Co1 | ++ | ++ |

Example 10

Cloning of Overexpression Cassettes for the Production of Cornexistin and Hydroxycornexistin using Heterologous Promoters Genes coding for the biosynthesis of cornexistin and hydroxycornexistin are expressed using heterologous promoters such as the Ptrpc promoter of *A. nidulans* (SEQ ID NO: 223). Promoter gene terminator fusions can be obtained by several technologies known to the person skilled in the art. Technologies are PCR fusion using overlapping primers for the promoter 3' side and the gene 5' side as well as promoter 5' primers and gene-terminator 3' primers. Methods for performing PCR fusion can be found in Nucl. Acids Res. (1989) 17: 4895. Another possible way to obtain promoter-gene terminator-fusion can be DNA synthesis by known methods (Czar et al. Trends in Biotechnology, 2009, 27, 63-72 and references therein).

Fragments containing promoter gene terminator fusions can be combined by several methods such as the Biobrick method, the Golden Gate Method, the SLIC Method, the CEPC Method (Li et al. Nature Methods 2007, 4: 251-256, Quan et al. PLOS ONE 4: e6441, Engler et al. PLOS ONE, 2008, 3 e3647, Engler et al. PLOS ONE, 2009 4 e5553).

All cassettes containing the promoter PtrpC (Seq ID NO: 223) and the genes coding for the open reading frame 1_9399 (Seq ID NO: 2), the orf 2_9399 (SEQ ID NO: 4), the orf 3_9399 (SEQ ID NO: 6), the orf 4_9399 (SEQ ID NO: 8), the orf 5_9399 (SEQ ID NO: 10), the orf 6_9399 (SEQ ID NO: 12), the orf 7_9399 (SEQ ID NO: 14), the orf 8_9399 (SEQ ID NO: 16), the orf 9_9399 (SEQ ID NO: 18) the orf 10_9399 (SEQ ID NO: 20), the orf 11_9399 (SEQ ID NO: 22), the orf 12_9399 (SEQ ID NO: 24), the orf 13_9399 (SEQ ID NO: 26), the orf 14_9399 (SEQ ID NO: 28) the orf 15_9399 (SEQ ID NO: 30) the orf 16_9399 (SEQ ID NO: 32) the orf 17_9399 (SEQ ID NO: 34) the orf 18_9399 (SEQ ID NO: 36) the orf 19_9399 (SEQ ID NO: 38) the orf 20_9399 SEQ ID NO: 40) the orf 21_9399 (SEQ ID NO: 42) the orf 22_9399 (SEQ ID NO: 44) the orf 23_9399 (SEQ ID NO: 46) are constructed by methods described above and cloned together or in two or more parts into the vector pPtrpC-Pcnat1 (SEQ ID NO: 58) or vector pHOFF6 (SEQ ID NO: 235).

Fragments containing all promoter-orf terminator cassettes can be isolated from the vectors using the SwaI digestion and are used for transformation of suitable fungal strains.

Example 11

Transformation of Cornexistin and Hydroxycornexistin Cluster DNA into *Paecilomyces divaricatus*

250 µl of a spore suspension are inoculated into a 500 ml flask (for one transformation experiment two flasks) with one baffle containing 100 ml of CCM medium (15 g/L Maltodextrin, 0.5 g/L NaCl, 0.5 g/L $K_2HPO_4$, 0.5 g/L $MgSO_4$×7 $H_2O$, 10 mg/L $FeSO_4$×7 $H_2O$, 5 g/L Tryptic-Soy-Broth, 1 g/L Yeast extract, 1 g/L Meat extract, pH 6.9-7.1), and are incubated for 3 days at 27 C and 120 rpm. Mycelium is harvested by filtration and washed by adding 20 ml of PP-buffer (0.9 M NaCl). The dried mycelium is transferred in a sterile flask, 30 ml of 3% Glucanex solution is added. Incubation is performed for 2 h at 27° C. and 100 rpm followed microscopic control of formed protoplasts. Filtration of protoplasts using a frit (pore size 1) is performed Centrifugation of the protoplast suspension is performed for 5 min at 4 C and 2500 rpm. Supernatant is discarded and the protoplast pellet is dissolved in 10 ml PP-buffer. The protoplast suspension is centrifuged for 5 min at 4 C and 2500 rpm in a sterile tube The pellet is dissolved in 5 ml TP1-buffer (0.9 M NaCl, 50 mM CaCl2).

The protoplast titre is determined using a Abbe-Zeiss counting cell chamber and the titre is adjusted to 1×108 protoplasts/ml TP1-buffer. 10 microgram of linear DNA 1 and 2 are mixed with 50 μl of the protoplast suspension. 12.5 μl of TP2-buffer (25% PEG 6000, 50 mM $CaCl_2$, 10 mM Tris, pH 7.5) are added and incubated for 20 min on ice. 500 μl of TP2-buffer are added, mixed gently and incubated 5 min at RT. 1 ml TP1-buffer are added. 2×780 μl of the transformation approach are mixed with 4 ml topagar I (CCM+20% sucrose+0.8% agar) and poured on CCMS plates. Plates are incubated at 27 C over night. All plates with expect of the regeneration controls are overlayed with 11 ml topagar II (0.8 M NaCl, 0.8% agar+Nourseothricin 50 μg/ml) and are incubated for >6 days at 26° C. Clones resistant against Nourseothricin are isolated, purified and analyzed for Cornexistin production in shake flask experiments.

Alternatively, 80 μL of conidiospores suspended in 1M Sorbitol (~2-5*$10^9$/mL) are mixed with 10 μg of DNA to be transformed. After 5 minute incubation on ice, the mix is transferred to a 0.2 cm cuvette. Electroporation is performed at 2.5 kV, 400Ω and 25 μF. The sample is immediately resuspended in 1 mL CCMS (CCM+20% sucrose) and regenerated over night at 26° C. and 100 rpm. The following day the spores are plated on CCMS (+2% agar) containing either 100 μg/mL Nourseothricin or 200 μg/mL Hygromycin and incubated for up to 6 days at 26° C. Resistant clones are isolated, purified and analyzed for Cornexistin production in shake flask experiments.

Example 12

Transformation of *Aspergillus niger* and *Aspergillus oryzae* with Cornexistin and Hydroxycornexistin Cluster DNA An *Aspergillus oryzae* strain, such as ATCC 1015 or *Aspergillus oryzae* ATCC 42149, or another strain, is cultured for 1 week at 30° C. in CD-Met (containing 40 μg/ml L-methionine) agar culture medium. Conidia (>$10^8$) are recovered from the Petri dish and inoculated into 100 ml of YPD liquid culture medium in a 500 ml flask. After culturing for 20 hours (30° C., 180 rpm), an aegagropila-like biomass is obtained. The biomass is collected on a 3G-1 glass filter and washed with 0.8M NaCl and then de-watered thoroughly and suspended in TF solution I (protoplastizing solution) and shaken for 2 hours at 30° C., 60 rpm. The material is examined with a microscope every 30 minutes and the presence of protoplasts is confirmed. Subsequently, the culture liquid is filtered and the protoplasts are recovered by centrifugal separation (2000 rpm, 5 minutes) and then washed with TF solution II. After washing, 0.8 vol of TF solution II and 0.2 vol of TF solution III are added and admixed and a protoplast suspension is obtained.

Plasmid DNA (10 μg of each vector DNA) of the vector for Introduction, p9399_Co1 and of ptrpC nat1 is added to 200 μl of this liquid suspension and left to stand over ice for 30 minutes, TF solution III (1 mL) is added and then mixed gently. Subsequently the mixture is left to stand for 15 minutes at room temperature and the plasmid DNA is introduced into the aforementioned protoplasts. TF solution II (8 mL) is added and the mixture is centrifuged (5 minutes at 2,000 rpm) and 1 to 2 ml of residual protoplast is recovered. The recovered protoplast liquid is dripped into re-generating culture medium (lower layer), the regenerating culture medium (upper layer) is poured in and, after mixing by rotating the Petri dish, the mixture is cultured for from 4 to 5 days at 30° C. The clones which emerged are isolated in regenerating culture medium (lower layer) and the transfectants (*Aspergillus oryzae* ATCC 1015 and *Aspergillus oryzae* ATCC 42149) are obtained by successive purification.

The abovementioned TF solution I (protoplastizing solution) is prepared using the composition indicated below.

| Compound | Concentration |
| --- | --- |
| Yatalase (Produced by the Takara-Bio Co.) | 25 mg/ml |
| Ammonium sulfate | 0.65M |
| Maleic-Acid-NaOH | 55 mM |

The abovementioned composition is prepared (pH 5.6) and then subjected to filtration sterilization. The abovementioned TF solution II is prepared using the composition indicated below.

| Compound | | |
| --- | --- | --- |
| 1.1M Sorbitol | | |
| 50 mM CaCl$_2$ | 10 ml 1M CaCl$_2$ (1/20) | |
| 35 mM NaCl | 1.4 ml 5M NaCl | |
| 10 mM Tris-HCl | 2 ml 1M Tris-HCl (1/100) | |
| Up to total volume | 200 ml | |

The abovementioned composition is prepared and then subjected to autoclave sterilization. The abovementioned TF solution III is prepared using the composition indicated below.

| Compound | | |
| --- | --- | --- |
| 60% PEG 4000 | 6 g | |
| 50 mM CaCl$_2$ | 500 μl 1M CaCl$_2$ (1/20) | |
| 50 mM Tris-HCl | 500 μl 1M Tris-HCl (1/100) | |
| Up to total volume | 10 ml | |

The abovementioned composition is prepared and then subjected to filtration sterilization.

The abovementioned culture medium is prepared using the composition indicated below.

| Compound | | Concentration |
| --- | --- | --- |
| Sorbitol (MW = 182.17) | 218.6 g | 1.2M |
| NaNO$_3$ | 3.0 g | 0.3% (w/v) |
| KCl | 2.0 g | 0.2% (w/v) |
| KH$_2$PO$_4$ | 1.0 g | 0.1% (w/v) |
| MgSO$_4$·7H$_2$O | 2 ml of 1M MgSO$_4$ | 0.05% 2 mM |
| Trace Elements Solution | 1 ml | |
| Glucose | 20.0 g | 2% (w/v) |
| Up to the total volume | 1 L | |

The abovementioned composition (pH 5.6) is prepared and then subjected to autoclave sterilization.

Example 13

Transformation of *Penicillium chrysogenum* ATCC11500, *Aspergillus japonicus*, *Aspergillus nidulans* and *Aspergillus fumigatus* with Cornexistin and Hydroxycornexistin Cluster DNA Protoplasts are prepared from five cellophane cultures of *A. nidulans* (ATCC 11414, ATCC 10864, or another strain) or *A. fumigatus* (ATCC 46645, or another strain) as described in Ballance et al., Biochem. Biophys. Res. Commun. 112 (1983) 284-2X9. After filtration through nylon filter cloth (Gallenkamp, GMX-500-V) and sintered glass (porosity I), the protoplasts are centrifuged at 1000×g for 5 min and then washed twice with 0.6 M KCl and once with 0.6 M KCl, 50 mM CaCl. The protoplasts are resuspended in 0.2 ml of 0.6 M KCl, 50 mM CaCl (0.5-5×10$^8$ ml and then 50-4 aliquots are dispensed into screw-capped tubes (Sarstedt). DNA (1 pg) is then added, followed by 12.5 μL TP2-buffer (25% PEG 6000 (BDH), 50 mM CaCl, 10 mM Tris' HCl, pH 7.5.) After 20 min incubation on ice, 0.5 ml of the above PEG solution is added and the mixture left at room temperature for 5 min. One ml of 0.6 M KCl, 50 mM CaCl$_2$, is added and aliquots are added to molten minimal medium containing KCl (0.6 M) and agar (2% w/v) which is then poured over minimal agar plates. When necessary, the transformation mixture is diluted in 0.6 M KCl, 50 mM CaCl. The efficiency of regeneration is assessed by plating aliquots of a 10$^{-3}$ dilution of the final transformation mixture in complete medium containing KCl and Nourseothricin. All plates except of the regeneration controls are overlayed with 11 ml topagar II (0.8 M NaCl, 0.8% agar+Nourseothricin 50 μg/ml) and are incubated for >6 days at 27° C.

Clones capable of growing on the antibiotic are isolated, purified by repeated incubation on Nourseothricin containing agar plates and are used for cornexistin and hydroxycornexistin production experiments.

Example 14

Growth of Fungal Strains after Transformation with DNA

Growth of fungal strains after transformation with DNA Media and cultivation of microorganisms: *Aspergillus nidulans*, *Aspergillus japonicus*, *Aspergillus fumigatus*, *Aspergillus niger* ATCC 10864, and *Penicillium chrysogenum* ATCC11500 strains that are successfully transformed with the genes of the cornexistin and hydroxycornexistin gene cluster from plasmid p9399_Co1 are cultivated at the appropriate incubation temperature (26° C. for *Penicillium chrysogenum*, 30° C. for *A. niger* and *A. japonicus*, 37° C. for *A. fumigatus* and *A. nidulans*) in YG (0.5% Yeast extract, 2% glucose), complete medium, or *Aspergillus* minimal medium with 1% (w/v) glucose as the carbon source and 5 mM of sodium glutamate as the nitrogen source and tryptophan (Biophys Acta 113:51-56). B. Alternatively the Strains are Grown on a Medium Containing Glucose-monohydrate 80 g/l, defatted wheat germ meal 10 g/l, defatted soy bean meal 16 g/l, L-glutamate 3 g/l, NaCl 1.25 g/l, CaCO3 1.5 g/l, silicon oil KM-72 0.03 g/l. Alternatively the strains are grown in a medium containing 30 g/l Mannitol, 10 g/l glucose, 10 g/l succinic acid, 1 g/l KH2PO4 0.3 g/l MgSO4*7H2O, with NH4OH to adjust the pH to 5.6. Solid media contained 1.5% Bacto-agar or, in the case of minimal agar plates, Difco-agar. If required, p-aminobenzoic acid (0.11 mM), Nourseothricin (50 µg/ml) are added). Clones resistant against the antibiotic are grown in 250 ml baffled shake flask with a power stroke of 5 cm at 160-250 rpm. 25 ml medium is inoculated with freshly grown mycelium and incubated for 7 d at the appropriate incubation temperature (26° C. for Penicillium, 30° C. for *A. niger*, 37° C. for *A. fumigatus* and *A. nidulans*). Cells as well as broth are harvested and are extracted as described in Furuta, Takaki; Koike, Masami; Abe, Matazo, Agricultural and Biological Chemistry (1982), 46, 1921-22

Example 15

Cornexistin and Hydroxycornexistin Produced by the Transformed Fungal Strains can be Analyzed by a Suitable HPLC Method Cornexistin and hydroxycornexistin are analyzed by the following HPLC method: An injection volume of a sample size of 2 µl is injected into a ROD-HLPC column, 50×4.6 mm (Merck KGa Darmstadt Germany) at a temperature of 40° C. For the elution a solvent as follows is used: acetonitril+0.1% TFA; water+0.1% TFA. The flow rate is set to 1.8 ml/min, detection of eluting compounds is performed by electrochemical detection. A standard of cornexistin and hydroxycornexistin is used for the calibration of the HPLC. Alternatively the following method can be used: Column: Eclipse XDB C18 (150*4.6 mm) at 40° C. with a flow rate of 1.00 mL/min and an injection volume of 10.0 µl. Detection was done at UV 210 nm. The maximal pressure was set to 300 bar. The Eluent A was $H_2O$ with 0.1% $H_3PO_4$, the eluent B was acetonitrile with the following gradient:

|  | A [%] | B [%] |
|---|---|---|
| 0.0 [min] | 80.0 | 20.0 |
| 5.0 [min] | 80.0 | 20.0 |
| 5.1 [min] | 65.0 | 35.0 |
| 16.0 [min] | 65.0 | 35.0 |
| 20.0 [min] | 0.0 | 100.0 |
| 30.0 [min] | 0.0 | 100.0 |

Example 16

Identification of the Biosynthesis Cluster via RNA-Seq 2 mL of *Paecilomyes divaricatus* conidiospore suspension (~$10^9$ spores/mL) are grown in 100 mL preculture medium (20 g/L glucose-monohydrate, 20 g/L polypeptone, 10 g/L malt extract, 10 g/L yeast extract, 1 g/L $K_2HPO_4$, 0.5 g/L $MgSO_4 \times 7\ H_2O$, 0.001% silicon oil AR 1000, pH 7.0) filled in 500 mL Erlenmeyer flasks without baffles. Flasks are incubated for 3 days at 26° C. and 220 rpm. 24×2 mL of the pre culture are used to inoculate 24×100 mL preculture medium filled in 500 mL Erlenmeyer flasks without baffles. 24×2 mL of the preculture are used to inoculate 24×100 mL production medium (50 g/L potato flakes, 50 g/L glycerol, 4 g/L urea, pH 6.0) filled in 500 mL Erlenmeyer flasks without baffles. All flasks are incubated for up to 13 days at 26° C. and 220 rpm. From day 2 on every day 2 flasks with mycelium grown in preculture medium and 2 flasks with mycelium grown in production medium are harvested, the supernatant is extracted and analysed for Cornexistin production by HPLC (FIG. 26, see Examples 9 and 15). RNA is isolated from mycelia grown in preculture medium for 3 days and from mycelia grown in production medium for 2, 3 and 6 days, respectively. RNA isolation and DNase digestion are performed using Qiagen's RNeasy Plant kit. RNA samples are used for transcriptome analysis via RNA-Seq. Results are delivered as comparative table and are investigated on a transcriptome wide basis by sliding window analysis (Table 26). For each gene the mean fold change averaged across +/−5 genes is determined (RPKM values of the 6th day in production medium compared to the 3rd day in preculture). A cutoff is set at a fold change of 5. The area with the biggest fold change contain the genes necessary for the biosynthesis of Cornexistin.

TABLE 26

Results of sliding window analysis of Example 16

| Gene Nr | SEQ ID | Average induction (production day 6/no production day 3) |
|---|---|---|
| 2585 | — | + |
| 2586 | — | + |
| 2587 | — | ++ |
| 2588 | — | ++ |
| 2589 | — | ++ |
| 2590 | — | ++ |
| 2591 | — | ++ |
| 2592 | — | ++ |
| 2593 | — | ++ |
| 2594 | — | ++ |
| 2605 | — | + |
| 2606 | — | + |
| 2607 | — | + |
| 2608 | — | + |
| 2609 | — | + |
| 6226 | — | + |
| 6662 | — | + |
| 6663 | — | + |
| 6664 | — | + |
| 1_9399 | 2 | 0 |
| 2_9399 | 4 | 0 |
| 3_9399 | 6 | 0 |
| 4_9399 | 8 | 0 |
| 5_9399 | 10 | + |
| 6_9399 | 12 | + |
| 7_9399 | 14 | ++ |
| 8_9399 | 16 | ++ |
| 9_9399 | 18 | ++ |
| 10_9399 | 20 | +++ |
| 11_9399 | 22 | +++ |
| 12_9399 | 24 | ++++ |
| 13_9399 | 26 | ++++ |
| 14_9399 | 28 | ++++ |
| 15_9399 | 30 | ++++ |
| 16_9399 | 32 | ++++ |
| 17_9399 | 34 | ++++ |
| 18_9399 | 36 | +++ |
| 19_9399 | 38 | +++ |
| 20_9399 | 40 | ++ |
| 21_9399 | 42 | ++ |
| 22_9399 | 44 | + |
| 23_9399 | 46 | + |
| 9159 | — | + |

TABLE 26-continued

Results of sliding window analysis of Example 16

| Gene Nr | SEQ ID | Average induction (production day 6/no production day 3) |
|---|---|---|
| 9768 | — | + |
| 9769 | — | + |
| 9770 | — | + |
| 9771 | — | ++ |
| 9772 | — | + |

Legend:
0: x < 5
+: 5 < x < 10
++: 10 < x < 100
+++: 100 < x < 300
++++: 300 < x How the genes within this cluster are induced is analysed as well and shows many genes within the cluster to be significantly induced on the 6$^{th}$ day in production medium compared to the 3$^{rd}$ day in preculture medium (Table 27).

TABLE 27

Results of Gene Induction Analysis of Example 16

| Gene | Function | Expression no Cornexistin production (day 3) | Expression Cornexistin production (day 6) | Induction (production day 6/no production day 3) |
|---|---|---|---|---|
| 1_9399 | AMP binding protein, phospho-pantheine binding protein | 0 | 0 | 0 |
| 2_9399 | Protein | 0 | 0 | 0 |
| 3_9399 | Protein | + | ++ | + |
| 4_9399 | Alkohol/keto oxido-reductase | + | ++ | + |
| 5_9399 | protein | 0 | 0 | 0 |
| 6_9399 | Transketolase | ++ | ++ | 0 |
| 7_9399 | Cytochrom P450 oxygenase | + | +++ | ++ |
| 8_9399 | Sugar transporter | 0 | ++ | + |
| 9_9399 | Lactone hydrolase protein | ++ | +++ | + |
| 10_9399 | Transporter protein | 0 | ++ | ++ |
| 11_9399 | Protein | 0 | ++ | ++ |
| 12_9399 | Transcriptional regulator protein | 0 | ++ | ++ |
| 13_9399 | Gluconolactonase protein | 0 | +++ | ++ |
| 14_9399 | Citrate synthase protein | 0 | +++ | +++ |
| 15_9399 | Dioxygenase protein | 0 | +++ | +++ |
| 16_9399 | Transporter protein | 0 | ++ | ++ |
| 17_9399 | Polyketide cyclase protein | 0 | +++ | +++ |
| 18_9399 | Methylcitrate synthase protein | 0 | ++ | + |
| 19_9399 | Thioesterase protein | + | +++ | + |
| 20_9399 | Polyketide synthase protein | 0 | ++ | ++ |
| 21_9399 | protein | 0 | ++ | ++ |
| 22_9399 | Protein | 0 | + | + |
| 23_9399 | Phosphotransferase protein | 0 | 0 | 0 |

Legend:
0: 0.1 < x < 10
+: 10 < x < 100
++: 100 < x < 1.000
+++: 1.000 < x < 10.000

Example 17

Deletion of the Polyketide Synthase in Cluster 9399

To confirm the identification of the correct cluster the polyketide synthase within the cluster 9399 is deleted using a split-marker system. The split marker fragments are amplified by PCR from plasmid pKO-PKS (SEQ ID NO: 224) using primers KO_PKS_1 fw and KO_PKS_1 rv (SEQ IDs NO: 225+226) for fragment 1 and primers KO_PKS_2 fw and KO_PKS_2 rv (SEQ IDs NO: 227+228) for fragment 2. *Paecilomyces divaricatus* is transformed with the 2 split marker knock-out fragments in an equimolar ratio (see Example 11). Genomic DNA is isolated from Nourseothricin resistant clones (see Example 3). Several PCRs are performed to identify clones with properly deleted polyketide synthase coding region. Primers Upstream 5' flank fw and clonNAT rv (SEQ IDs NO: 229+230) are used to verify correct recombination of the split marker fragments upstream of the polyketide synthase coding region. Primers clonNAT fw and Downstream 3' flank rv (SEQ IDs NO: 231+232) are used to verify correct recombination of the split marker fragments downstream of the polyketide synthase coding region. Primers PKS fw and PKS rv (SEQ IDs NO: 233+234) are used to confirm deletion of the polyketide synthase within the Cornexistin biosynthesis cluster. Only the wild type strain and heterokaryotic deletion strains show a signal in this PCR. In order to obtain homokaryotic deletion strains one round of single spore isolation is performed. The wild type strain and 3 polyketide synthase deletion clones are investigated for Cornexistin production by shake flask experiments:

2 mL of *Paecilomyes divaricatus* conidiospore suspension (~10$^9$ spores/mL, either from wild type or from deletion clones) are grown in 100 mL preculture medium (20 g/L glucose-monohydrate, 20 g/L polypeptone, 10 g/L malt extract, 10 g/L yeast extract, 1 g/L K$_2$HPO$_4$, 0.5 g/L MgSO$_4$×7 H$_2$O, 0.001% silicon oil AR 1000, pH 7.0) filled in 500 mL Erlenmeyer flasks without baffles. Flasks are incubated for 3 days at 26° C. and 220 rpm.

2 mL of the pre culture are used to inoculate 100 mL production medium (50 g/L potato flakes, 50 g/L glycerol, 4 g/L urea, pH 6.0) filled in 500 mL Erlenmeyer flasks without baffles. All flasks are incubated for 11 days at 26° C. and 220 rpm. The mycelium is harvested and the supernatant is extracted and analysed for Cornexistin production by HPLC (see Examples 9 and 15).

TABLE 28

Results of Example 17:

| Strain | Productivity of Cornexistin [mg/L] |
| --- | --- |
| SANK 21086 | 29.84 |
| SANK 21086, Δpks clone 1 | 0.0 |
| SANK 21086, Δpks clone 2 | 0.0 |
| SANK 21086, Δpks clone 3 | 0.0 |

Example 18

Overexpression of the Transcriptional Regulator in Cluster 9399 for the Production of Cornexistin and Hydroxycornexistin In order to increase Cornexistin and Hydroxycornexistin production the transcriptional regulator present in cluster 9399 (SEQ IDs NO: 24+25) is overexpressed using the strong HSP9 promotor from Paecilomyces divaricatus (SEQ ID NO: 236). For this means the overexpression plasmid pHOFF6 Phsp9-TF1 (SEQ ID NO: 239) is constructed using CPEC (Circular Polymerase Extension Cloning). Paecilomyces divaricatus is transformed with the circular overexpression construct pHOFF6 Phsp9-TF1 (SEQ ID NO: 239) (see Example 11). Genomic DNA is isolated from Hygromycin resistant clones (see Example 3). PCR is performed using primers Phsp9 fw and TF rv (SEQ IDs NO: 240+241) to identify clones with an integrated overexpression construct. The wild type strain and 5 transcription factor overexpression clones are investigated for Cornexistin production by shake flask experiments:

2 mL of Paecilomyes divaricatus conidiospore suspension (~10$^9$ spores/mL, either from wild type or from overexpression clones) are grown in 100 mL preculture medium (20 g/L glucose-monohydrate, 20 g/L polypeptone, 10 g/L malt extract, 10 g/L yeast extract, 1 g/L K$_2$HPO$_4$, 0.5 g/L MgSO$_4$×7 H$_2$O, 0.001% silicon oil AR 1000, pH 7.0) filled in 500 mL Erlenmeyer flasks without baffles. Flasks are incubated for 3 days at 26° C. and 220 rpm.

2 mL of the pre culture are used to inoculate 100 mL production medium (50 g/L potato flakes, 50 g/L glycerol, 4 g/L urea, pH 6.0) filled in 500 mL Erlenmeyer flasks without baffles. All flasks are incubated for 13 days at 26° C. and 220 rpm. The mycelium is harvested and the supernatant is extracted and analysed for Cornexistin production by HPLC (see Examples 9 and 15). The results show the averaged titer of 2 independent shake flasks per clone.

TABLE 29

Results of Example 18:

| Strain | Productivity of Cornexistin [mg/L] |
| --- | --- |
| SANK 21086 | 427.68 |
| SANK 21086, Phsp9-TF clone 1 | 526.36 |
| SANK 21086, Phsp9-TF clone 2 | 689.60 |
| SANK 21086, Phsp9-TF clone 7 | 734.62 |
| SANK 21086, Phsp9-TF clone 10 | 735.25 |
| SANK 21086, Phsp9-TF clone 11 | 932.42 |

Example 19

Production of Cornexistin and Hydroxycornexistin in Potato-free Medium using the Transformants from Example 18 a) In order to produce Cornexistin and Hydroxycornexistin independent of potato components the transcriptional regulator present in cluster 9399 (SEQ IDs NO: 24+25) is overexpressed using the strong HSP9 promotor from Paecilomyces divaricatus (SEQ ID NO: 236). For this means the overexpression plasmid pHOFF6 Phsp9-TF1 (SEQ ID NO: 239) is constructed using CPEC (Circular Polymerase Extension Cloning). Paecilomyces divaricatus is transformed with the circular overexpression construct pHOFF6 Phsp9-TF1 (SEQ ID NO: 239) (see Example 11). Genomic DNA is isolated from Hygromycin resistant clones (see Example 3). PCR is performed using primers Phsp9 fw and TF rv (SEQ IDs NO: 240+241) to identify clones with an integrated overexpression construct. The wild type strain and 5 transcription factor overexpression clones are investigated for Cornexistin production by shake flask experiments:

2 mL of Paecilomyes divaricatus conidiospore suspension (~10$^9$ spores/mL, either from wild type or from overexpression clones) are grown in 100 mL preculture medium (20 g/L glucose-monohydrate, 20 g/L polypeptone, 10 g/L malt extract, 10 g/L yeast extract, 1 g/L K$_2$HPO$_4$, 0.5 g/L MgSO$_4$×7 H$_2$O, 0.001% silicon oil AR 1000, pH 7.0) filled in 500 mL Erlenmeyer flasks without baffles. Flasks are incubated for 3 days at 26° C. and 220 rpm.

2 mL of the pre culture are used to inoculate 100 mL modified preculture medium (20 g/L glycerol, 10 g/L malt extract, 10 g/L yeast extract, 3.6 g/L ACES, 0.5 g/L MgSO$_4$×7 H$_2$O, 0.001% silicon oil AR 1000, pH 6.0) filled in 500 mL Erlenmeyer flasks without baffles. All flasks are incubated for 13 days at 26° C. and 220 rpm. The mycelium is harvested and the supernatant is extracted and analysed for Cornexistin production by HPLC (see Examples 9 and 15). The results show the averaged titer of 2 independent shake flasks per clone.

TABLE 30

Results of Example 19 a):

| Strain | Productivity of Cornexistin [mg/L] |
| --- | --- |
| SANK 21086 | 0.0 |
| SANK 21086, Phsp9-TF clone 1 | 5.10 |
| SANK 21086, Phsp9-TF clone 2 | 35.68 |
| SANK 21086, Phsp9-TF clone 7 | 6.54 |
| SANK 21086, Phsp9-TF clone 10 | 5.85 |
| SANK 21086, Phsp9-TF clone 11 | 11.98 | b) Alternatively, the wild type strain and 5 transcription factor overexpression clones are investigated for Cornexistin production by modified shake flask experiments:

2 mL of *Paecilomyes divaricatus* conidiospore suspension (~$10^9$ spores/mL, either from wild type or from overexpression clones) are grown in 100 mL preculture medium (20 g/L glucose-monohydrate, 20 g/L polypeptone, 10 g/L malt extract, 10 g/L yeast extract, 1 g/L $K_2HPO_4$, 0.5 g/L $MgSO_4 \times 7\ H_2O$, 0.001% silicon oil AR 1000, pH 7.0) filled in 500 mL Erlenmeyer flasks without baffles. Flasks are incubated for 3 days at 26° C. and 220 rpm.

2 mL of the pre culture are used to inoculate 100 mL modified preculture medium (50 g/L glycerol, 4 g/L urea, 10 g/L malt extract, 10 g/L yeast extract, 3.6 g/L ACES, 0.5 g/L $MgSO_4 \times 7\ H_2O$, 0.001% silicon oil AR 1000, pH 6.0) filled in 500 mL Erlenmeyer flasks without baffles. All flasks are incubated for 13 days at 26° C. and 220 rpm. After 7 days 10 mL 50% w/v glycerol are added in every flask and incubation is continued until day 13. The mycelium is harvested and the supernatant is extracted and analysed for Cornexistin production by HPLC (see Examples 9 and 15). The results show the averaged titer of 2 independent shake flasks per clone.

TABLE 31

Results of Example 19 b):

| Strain | Productivity of Cornexistin [mg/L] |
|---|---|
| SANK 21086 | 1.67 |
| SANK 21086, Phsp9-TF clone 1 | 115.81 |
| SANK 21086, Phsp9-TF clone 2 | 125.31 |
| SANK 21086, Phsp9-TF clone 7 | 20.55 |
| SANK 21086, Phsp9-TF clone 10 | 69.02 |
| SANK 21086, Phsp9-TF clone 11 | 189.60 |

Example 20

Overexpression of the Transporter Protein 10 in Cluster 9399 for the Production of Cornexistin and Hydroxycornexistin In order to increase cornexistin and hydroxycornexistin production the transporter protein 10 present in cluster 9399 (SEQ IDs NO: 20+21) is overexpressed using the heterologous constitutive promotor trpC of *A. nidulans* (SEQ ID NO: 223). For this means the overexpression plasmid pHOFF6-transporter10 (SEQ ID NO: 242) is constructed using In-Fusion Cloning. *Paecilomyces divaricatus* is transformed with the circular overexpression construct pHOFF6-transporter10 (SEQ ID NO: 242) (see Example 11). Genomic DNA is isolated from Hygromycin resistant clones (see Example 3). PCR is performed using primers Transporter 10 fw and TtrpC rv (SEQ IDs NO: 243+244) to identify clones with an integrated overexpression construct. The wild type strain and 1 transporter overexpression clone are investigated for Cornexistin production by shake flask experiments:

2 mL of *Paecilomyes divaricatus* conidiospore suspension (~$10^9$ spores/mL, either from wild type or from overexpression clones) are grown in 100 mL preculture medium (20 g/L glucose-monohydrate, 20 g/L polypeptone, 10 g/L malt extract, 10 g/L yeast extract, 1 g/L $K_2HPO_4$, 0.5 g/L $MgSO_4 \times 7\ H_2O$, 0.001% silicon oil AR 1000, pH 7.0) filled in 500 mL Erlenmeyer flasks without baffles. Flasks are incubated for 3 days at 26° C. and 220 rpm.

2 mL of the pre-culture are used to inoculate 100 mL production medium (50 g/L potato flakes, 50 g/L glycerol, 4 g/L urea, pH 6.0) filled in 500 mL Erlenmeyer flasks without baffles. All flasks are incubated for 13 days at 26° C. and 220 rpm. The mycelium is harvested and the supernatant is extracted and analysed for Cornexistin production by HPLC (see Examples 9 and 15). The results show the averaged titer of 2 independent shake flasks per clone.

TABLE 31

Results of Example 20:

| Strain | Productivity of Cornexistin [mg/L] |
|---|---|
| SANK 21086 | 360.23 |
| SANK 21086, PtrpC-Transporter10 clone 16 | 702.31 |

Example 21

Overexpression of the Polyketide Synthase in Cluster 9399 for the Production of Cornexistin and Hydroxycornexistin In order to increase cornexistin and hydroxycornexistin production the polyketide synthase present in cluster 9399 (SEQ IDs NO: 40+41) is overexpressed using the strong HSP9 promotor from *Paecilomyces divaricatus* (SEQ ID NO: 236). For this means the overexpression plasmid pHOFF6 Phsp9-polyketide synthase (SEQ ID NO: 247) is constructed using In-Fusion Cloning. *Paecilomyces divaricatus* is transformed with the circular overexpression construct pHOFF6 Phsp9-polyketide synthase (SEQ ID NO: 245) (see Example 11). Genomic DNA is isolated from Hygromycin resistant clones (see Example 3). PCR is performed using primers Phsp9 fw and PKS rv (SEQ IDs NO: 240+246) to identify clones with an integrated overexpression construct. The wild type strain and 1 polyketide synthase overexpression clones are investigated for Cornexistin production by shake flask experiments:

2 mL of *Paecilomyes divaricatus* conidiospore suspension (~$10^9$ spores/mL, either from wild type or from overexpression clones) are grown in 100 mL preculture medium (20 g/L glucose-monohydrate, 20 g/L polypeptone, 10 g/L malt extract, 10 g/L yeast extract, 1 g/L $K_2HPO_4$, 0.5 g/L $MgSO_4 \times 7\ H_2O$, 0.001% silicon oil AR 1000, pH 7.0) filled in 500 mL Erlenmeyer flasks without baffles. Flasks are incubated for 3 days at 26° C. and 220 rpm.

2 mL of the pre-culture are used to inoculate 100 mL production medium (50 g/L potato flakes, 50 g/L glycerol, 4 g/L urea, pH 6.0) filled in 500 mL Erlenmeyer flasks without baffles. All flasks are incubated for 13 days at 26° C. and 220 rpm. The mycelium is harvested and the supernatant is extracted and analysed for Cornexistin production by HPLC (see Examples 9 and 15). The results show the averaged titer of 2 independent shake flasks per clone.

TABLE 33

Results of Example 21:

| Strain | Productivity of Cornexistin [mg/L] |
|---|---|
| SANK 21086 | 488.37 |
| SANK 21086, Phsp9-polyketide synthase clone 14 | 584.39 |

Example 22

Overexpression of Genes on Fragment D of Cluster 9399 for the Production of Cornexistin and Hydroxycornexistin In order to increase cornexistin and hydroxycornexistin production genes on the cluster fragment D of cluster 9399 (SEQ ID NO: 247) are overexpressed by inserting a second copy of this fragment. For this means the plasmid pFragment D (SEQ ID NO: 248) is constructed using transformation associated recombination in *Saccharomyces cerevisiae*. *Paecilomyces divaricatus* is transformed with the circular overexpression construct pFragment D (SEQ ID NO: 248) (see Example 11). Genomic DNA is isolated from Nourseothricin resistant clones (see Example 3). PCR is performed using primers AmpR fw and 5' Fragment D rv (SEQ IDs NO: 249+250) and primers 3' Fragment D fw and PtrpC pcnatl rv (SEQ IDs NO: 251+252) to identify clones with fragment D being integrated at both the 5' and 3' end. Fragment D contains genes encoding for the transcriptional regulator, the gluconolactonase, the citrate synthase and the dioxygenase (SEQ IDs NO: 24-31). The wild type strain and 2 fragment D overexpression clones are investigated for Cornexistin production by shake flask experiments:

2 mL of *Paecilomyes divaricatus* conidiospore suspension (~$10^9$ spores/mL, either from wild type or from overexpression clones) are grown in 100 mL preculture medium (20 g/L glucose-monohydrate, 20 g/L polypeptone, 10 g/L malt extract, 10 g/L yeast extract, 1 g/L $K_2HPO_4$, 0.5 g/L $MgSO_4$×7 $H_2O$, 0.001% silicon oil AR 1000, pH 7.0) filled in 500 mL Erlenmeyer flasks without baffles. Flasks are incubated for 3 days at 26° C. and 220 rpm.

2 mL of the pre-culture are used to inoculate 100 mL production medium (50 g/L potato flakes, 50 g/L glycerol, 4 g/L urea, pH 6.0) filled in 500 mL Erlenmeyer flasks without baffles. All flasks are incubated for 13 days at 26° C. and 220 rpm. The mycelium is harvested and the supernatant is extracted and analysed for Cornexistin production by HPLC (see Examples 9 and 15). The results show the averaged titer of 2 independent shake flasks per clone.

TABLE 36

Results of Example 22:

| Strain | Productivity of Cornexistin [mg/L] |
|---|---|
| SANK 21086 | 488.37 |
| SANK 21086, Fragment D clone 1 | 842.18 |
| SANK 21086, Fragment D clone 3 | 560.25 |

Example 23

Overexpression of Genes on Fragment F of Cluster 9399 for the Production of Cornexistin and Hydroxycornexistin In order to increase cornexistin and hydroxycornexistin production genes on the cluster fragment F of cluster 9399 (SEQ ID NO: 253) are overexpressed by inserting a second copy of this fragment. For this means the plasmid pFragment F (SEQ ID NO: 2254) is constructed using transformation associated recombination in *Saccharomyces cerevisiae*. *Paecilomyces divaricatus* is transformed with the circular overexpression construct pFragment F (SEQ ID NO: 254) (see Example 11). Genomic DNA is isolated from Nourseothricin resistant clones (see Example 3). PCR is performed using primers AmpR fw and 5' Fragment F rv (SEQ IDs NO: 249+255) and primers 3' Fragment F fw and PtrpC pcnat1 rv (SEQ IDs NO: 256+252) to identify clones with fragment F being integrated at both the 5' and 3' end. Fragment F contains genes encoding for the polyketide synthase, a protein and another protein (SEQ IDs NO: 40-45). The wild type strain and 1 fragment F overexpression clone are investigated for Cornexistin production by shake flask experiments:

2 mL of *Paecilomyes divaricatus* conidiospore suspension (~$10^9$ spores/mL, either from wild type or from overexpression clones) are grown in 100 mL preculture medium (20 g/L glucose-monohydrate, 20 g/L polypeptone, 10 g/L malt extract, 10 g/L yeast extract, 1 g/L $K_2HPO_4$, 0.5 g/L $MgSO_4$×7 $H_2O$, 0.001% silicon oil AR 1000, pH 7.0) filled in 500 mL Erlenmeyer flasks without baffles. Flasks are incubated for 3 days at 26° C. and 220 rpm.

2 mL of the pre-culture are used to inoculate 100 mL production medium (50g/L potato flakes, 50 g/L glycerol, 4 g/L urea, pH 6.0) filled in 500 mL Erlenmeyer flasks without baffles. All flasks are incubated for 13 days at 26° C. and 220 rpm. The mycelium is harvested and the supernatant is extracted and analysed for Cornexistin production by HPLC (see Examples 9 and 15). The results show the averaged titer of 2 independent shake flasks per clone.

TABLE 37

Results of Example 23:

| Strain | Productivity of Cornexistin [mg/L] |
|---|---|
| SANK 21086 | 488.37 |
| SANK 21086, Fragment F clone 4 | 607.28 |

SEQUENCE LISTING (256 sequences)

SEQ ID NO: 1 - DNA, 58525 bp, Paecilomyces divaricatus
  gene (1001)..(4395)
  gene (4937)..(5965)
  gene (7505)..(8236)
  gene (9322)..(10368)
  gene (11274)..(11354)
  gene (12423)..(14345)
  gene (15965)..(17599)
  gene (18123)..(19631)
  gene (20880)..(21831)
  gene (22165)..(23763)
  gene (24308)..(26547)
  gene (26750)..(28222)
  gene (29894)..(31024)
  gene (31399)..(32996)
  gene (34706)..(35799)
  gene (37437)..(39097)
  gene (39414)..(40500)
  gene (40981)..(42510)
  gene (42995)..(43808)
  gene (44518)..(52300)
  gene (52707)..(53415)
  gene (54385)..(55295)
  gene (56158)..(57525)
tgagaacgatagcagaagaatagtaacgtgttgagtcagctcattacaaaccgtctcgaagctttccgatagattattggatgagtgggctgggactcacggtccgaacctggtttccacaggacgcttgcgaatggagcatggcaagccagctgttgggaggggatgattcgtggagaagcttgccccagcgtaccgtaaccggggagggcatcctacgtgtcctgaagagtgagaaaccctcgggggcagtcgactaaatttcagatatgatcctaactgaaagcgtgcttcaccaaagcgcattgtgagtcgatatgcctaatcgatggattaagtctagttatcctgtgaatgtaagaggtggtagcagctgttgagggcccagggactaaagagtcgtggccctccaattgtgctaaagaactgtgtaaggatgagagagcctgatttagcttatatgaaacagatttccgtatggcaaattgtattatctgcgatccagtactgcaacatggagcacaaaacctaggctctgtaccattcgcggggcttccgtggagaggtttccagggtcagctacctacctaggtaggacgcctagcgaaagcattgctgtactaatttctgacagaagattactattgacgcaatgtggccctcggatcaggcgtccactccaggttcaggacgaatagacgtggttatctgagcgaatttgccggcgcagccagggtagctgagtacggatgcgtgagaatattacctgttaaaggctcaaaatgacaagcatttcctcctgtgggatgcaataccatcttatcagagggtccgttcactcagtgcctgcgatatttattggctcttgagcccctcgattatttccttatctctcatgctcatgttgaggaatctggtaataactccctggtgatcgcttttgcgcgaagacggcacctactcagtacaacttgtgttctttcttgacagttttgcaaagatgggctcgagtaccttcgagcacgatagcacccccgaatatgggaaacgtttcctaccccatatgatcgatgaaagagcggcttcaggccattcacgtccttatgcttatattgccagatctccgcatccccaggacggcttcgaggaagtcagctacgcacgtctggcgaatgcaatcaaccgggcttcctggtgggtagtcaatgaattaacccctttgactggtgagaatggtgtcttcgcgtacatgggtccgaacgacctgcgatatctgatactgtctgttgcggctataaaaaccggcagaaaggtgggttacctccatttactccataggacgaagaacacggctgatggcgtagatgcttcaaccatcaatgaggaatactgttgaagcacagcagttgctattccaacgcatcggatgcaagacaatcgcctacgcagctaccctggagaagagtctacatcctattttcacatccatctccgggctgcagaccaagcaggctcctagtttagaggatttcctttcggaagatgtggttcctcacttcgaatacaagggcagctacgaaaaattgaccgatgaaccgctcatatacttccacacgtctggatcttcaggtctgttgcctctagtttactgagcgcatctcctagttaactatgagaacaggaaatccgaaaccaattggtttcagtctgcgatggcttcttctcttctctgatgctcccaatttaccccctattaatagtcgcccgtcaacagtgaaggagggcctgtaccgccaaaatactttatgtttccttccaccgttccatgtatgtatggggccctggatatcgagtgcatgatccttgtgagctaaactgtaataggccggcggattcggtcttgctgccgcagtggtgtactttgaagccattgctgtttgtcctcatccggaggttgcaccaacagcagaatacatattgtcgctgctagaccaaaatattgccacggccttatcggttccgccttctctacttgacgcactctcgaagacatctgctgggatcgaggctttgtctaagctggaacacgttggctacgtcggaggcccgttgcccgagcacgttgggcaggctcttgcgccaaagctgaagcacctctacagtctaatgggggcaacggagtgtggctggttccataccatacctggcgacagcagcaaatgggcgtatctacgtttcaacccggatattggctatcggttcgatgagatctccgaaggggtcttcgaattggtcatacctaatagtcccgtaaccaggaaagtgcatggtaccccacatatatttccggaactgaacgaatacagaacaagagatctttactccttagtcccgggagaggaagggtggatgcgttaccagggaaggagtgacgatcttatagtcctgtccaacggtgagaagatcaatcctgtacctctggagggtattataaacagccattcagcgatcaagggtgccctcattgtgggggagtatcgattcttgccttctcttctgatagaggtccaggatgatttcagcgctgaaacagaagaggagcgtctggagctgcttgacaagatctggccaaccgtcgaacaagcaaataagatcgccccacgcttctcccgggtaccgaagtccttgatctatcttgggaagaaggatgaacactttcacagagctgggaaggggaccatccagcgtcagcgcaccgtcagcaactttgcgaaggccttagatgaactatacttcgctgcagagcaggggctgcttgtggaaggtctagagttggatgacccctcaaataaggattcgatcagagcgttcaccaggaagctttacgctcaagctctagatgccgaggaaatcaaagacgaagatgacgtctttaatctcggcatagactctcttcaagtcgctatcacggttcagaagattagggcgaccatgagggcacgaccggtagaactggaccatgagcagatcaatggacaactgatttactctaacccaacggcaggtgaccttgcaacggccctcaataagctcgtaaactgtgaaagaggtgtacctctggacggctctctcaatggtgtcaacgaacgttcgactcgtttgcagcagctacttgacaagtacatagcagcaatgcccacgatgctcgatgaggcggaaaaagcgaatacgggccgctcgactgtcattttgacaggttcaactggttctttaggaagctacctcttgacaaccttgttgtcctcgcctgcagtctcgaaggtagtctgtctcaatcgatctagtgacagcgaaaagcgccagagagctattcataacgcacgtggacaagctatatcttgggagaaagaagaccgagagagagtcgaattcttaacagcagatttatcaaaaccagaccttggtctgggggatcagaaatacagtgatctattgtcagaagcatcagcaatcatccactgcagctggaaagtcgatttcaatcacactctcagttctttcgaagcgacccatattgccggggtgataaatctgatcacactcagcgccaaatctgcacaccacgcacctattatgtttgtctcgagtatatccacagtcttcaattggatcgaaacgcacccgaatctccctgtcccggaagccattctcaatgatctagacagctccgagaaactaggctatggagagtcaaaatatataggcgaaagactaatcgaggcttataccgcgtccacgggcattcaaaatgtcgtcctgagagtcggacaaattgcaggcccggtactttcctcttctggattctggaataagcaggaatggttccccagcctggtcgccagctcaaaacacctgggattattgcctgagtcactagggactatgaatacgattgattggataccggttgaccttctggcatcgattatcacccagctgcttcaatccgtccacaacagcccggaatccgaagtgaagtcacctgctgtctataacctcgtcaaccctcgagtgactacatggcccgctcttctccacagcgttcaagaagaccttggtggacaatcaaacgtacgagtcgtcccattgtcagaatgggtggaagcgcttgagagaagtgcttcgcacaatcacgggtatgtgatagcagagaacccagctgttaaactgcttgatttcttcaagctgctagggaagaacggagaggggaacgtgggcgaagcgaaatcgcaatataaggtagctcgcctgctgagggatagtccacaggctagacagctgggcttcgtttctccagaatggatgcggatgtggttgaagcagtggaagttgtgaaatggctgattcattgtcttgtgattctatattatttttatgttttattagcaacgttgatggatggggcccactgaacgagatacttctatatctgaaatagattgaccgacaagaatatcagttctattccatatcagatgcacagaacaatcatgagaaactgggctaaccagtgacgtgcggttgaccaaatcctatagttcataaactgacaggcagccactagaattccgaggttcatcccgccaactttatcttcgggttaggatatttctgctaagtttggtagactactcttcatcttggttggcacgtaaggctacagcgccaggcatccaccaactgcagagtgaaatgagggcgggctccgcactcttcactctgtgcatcgtcccttgttattgtttattgccagcctcaccgtgtctttccagtaccatgcctgtgtccatcttgcaaggcactcgaggattgttctaggtcgccgacagagatcagcatcgttcgtatatctgaaacaaccgatactcagtccaacatgggctacctcgagaatctgcccgcagaactgctgttcctgatcgtcgaccagcttgacagatatgacttgatgaacttgcgcgtggtacaccggcgcttcagtttcgtgaacccacgtgtcttcaaggtcatgcgtttctacaacgagcctaccgtccccgtgaaacttcgcaagctgctcaaacgggaggatatgagatccgctctggacgagataatcttttcgacagactctctcttccggggttacaaccggcacgatgcagccctgaggctcaagagggttgcccgtctgctcgcaaatcacgacgatgtcaacatcaaaaccgtacatctcgtcggcgattcaggaggtctgggacttctgcttcgttactttgcagaagcaggtatcaggtcgcttcggtacctctctggcgccataatttttcgccaccatgagatcaacgaggaatggcttcctcacctgatggatgagtctggcgtcttggaagtcttgggaggcttggaacgcctggacctcactctcaataataggtccgggtttatctcgcacccccgcggtttttccccccacgattttcccaacatatacagcatcatggccgccacgccgagcttgactgagctccttctcaagggcattgaaggacaagattttagcgacatgttggggtgttttatgttcttccggcggaggtcggcttttcctccccggctccgaaaagtgactgtggagcgctgccacactccgctcagcttcctcacacggatcatcaaccatccaagcatcgaagatgtcaccctctcttcggtctctctcattttggatcgatctgagggcattgatgcgaggcggtattatatccgtaagtggcaggacttcttggaagctttcagtgatatatactacgacggcgaggagactcgtaagcggttgactgtgggcgagttgtgggaacgtggcaatctggctacgattgacgttaaccatttgcttggagtgactctattggatccaaactaaagcctaggtgtggagggctagatagcctgtggtggacaccttacgcagtcagttgttcgatactgtggcacatatcgagttggagagctctagaccgtcgatgactatctacttgttctcttccattcgatattgttcttttgtacccaccgatttgattgtcatacttttcgcttaaactgttcgtgggccgagataataaagacgattacttagattcatagcttcaaggcacaaagtttaataatgttaattagaaattcgtacgtgtgacagttcttaaatgagctcctgactgctggcccagaaacaggctgctaggagtctagagagaaaaaacagaagagagagggacggggggggggggttgtatagataagtattaaagtgatcatggtcggtcagtcgcaccgttggcaggcgcacggaccatgggtgcgatctattgattgcggaggagacgcgacgggatccacggaccccaattgattgatcaaccaatggaggggcgataaactcccaggtgggcataggggacatggtcgtgaaatagatccaaaataggtagggttgaagctgcggagagcagggagaccgggggtccgtgtctagtttagccatactacacggaatacagtacgatgtcgacgtatactctaatcctgctggattcagcgtatcgcaccgagcccgcaggtggtgttagtggcagaacaccaccggcagttctctagttaggaagatgtgaaagcctttagggaaggggatcctatttggctagtagcctagtactatctagaggttgtggatttgaatcttactgtaagcaaaagttgccgtattttgtgggaaaggcgaagaagcctagattcagggatgctaggcatcgtgagctacctacctaggtaggtagctatatagccatgccaaggcactaggcgaggacatcccggaggagcacggaagacgtggtctccaacatagatattttagataccttcttagggagatctggatgggtggctagtctattctaagttatggaggcgggacgggaggggaacacaggctagtgccatgtgctgatatgcccttattcctacctagctagtggatatgaagaaccttatctgagggattaattggctgttttaacctgctccttataagaaagggactagttaaccttatctatgcagaaattgtgaaggaataatgaagaatccatcttatgtaactagctagctattaacttattgggggcggcaggtcagagaagaatccatcctatatataacaggaattggactagatctgcatgtgatcaagcagaaaggatatactctagagtattgaagaccactacagaccatctatttgtggcctattgataatcggattaagttgacagatccgtgaatgaactgattgattgattgcatgtatcccaccccacatggcgccatatctagccctgacgagtccactgaaccccggtgcaaccccataacgcgtgaaaataaacgtccgccctgctcctcatctcaaaagcccgaccaacgtcactagccggtccatcgacaccatcagagagtcctcgcactcctgcagcgagaaggattgttgggggcgattccgatgccacacattctccaggatgagtttcagctcgccgatcagggcccccaggtccgccaatcgccggcgcaggagcatgccggcgagcagttgcgcgtcttcttcatggatctcgatatcgccccatgtcatcgggctggtgcaacagaccgggggcccgttcatcgtcccggggaaatcgtccgcgctggccagaccgtctgctccatcggaggaggagccaggtggccgaggaagggacagcgtcgaggagcgggatctccgcccggtgcccaaccgctccgggctcctcagatccccttctcccaatgcataggcggaaaaggccccctcatacagggccaaccccagatcgaggacgcactgtagggtgatgatggcatgccagtgggtccggcagtgctcgcaggccaccatgtgcgcacactgggtggtgatatcggcgcccaaactcaggatcgtatcaaaggagaccgggtagtgatctggcagcttccccatcacctgcaccatgccatggatgcaatcgcacggggtgttgatgttggcggcgttggcttgaatgtccccataccggcgcgcgaggatctcgatgttctgtacggcattgggcgtcttgacggtggtcagcatggtcactcggtgggagcagctcaaccggctggcctcatgggaggcaacggatgagtctggattatatcatgtagtgcgaagcgaatcgtggcttggggtgagattcgtcagcgcttctcccaagttccagattttcagactgcgcgaactggccggaggctctatggaaaaagaaaatagtgtatacacagtataaagggtataccttggccgatgtcaaaagtaagaccgatcctgatccctggtcactgggggccagtggtgtttcggatgcactcgagccgcgggaggttttcgacagcctccaagccaccttgacatgatgacgatgatgactgcatctgatccgccgcttatcactgcaacaaggggcaagaaagatatggaaagttcgcagtacttctcagtgatcgaattgcgactctcatgtcagggatcagccagtcaggcccgtggtggctcccagatggtgtcaggaccgactcctctgggcggttcgctggtgcctgggcagtctgcttagtcggccaccgatctagttatatagcagtccagacccaagtttcggcttccttcagatcctcgtgtcgccacgggacgccaatgagcttgttctggccctccagatgatctgccggagagcaagaacgcggaatccttccgatccgtcccctgtagttccttggctgggacgtactagattctcccctgggcccgtgtcttccgcactcttatcttacgtctcttgcgcacttttggcccccatccccgggaattaggaggacccctcctggctattgccatcttccggaacacggctaacctgtgaggtcaggatgagtgggtagatgagatccgacaaggtacgcagtgagaatctattgaatgtgacagtcaagaaagaaaccgctgattgcatggctctatgacacaaagacagagccttggatatgggtactagatgcttccagcaagatagagtctggatatattgttctctcttgccatcagtctgtttattgagttggaccatgaccatcgctcttcaatagcaggcagagcgtgaatcttacagcttctgcaagctaggtatgtttctgagccatatggtatttttcaatccgagtgaggggctgctctttgtcccccagacatgcctgggccgaagctccgatctgcatcacctcgtccggtgtgatctggaagtcgaagaccctgagataccccttcattcggtcctcatggcgactggttgtgatcgtggcaaccccctgctcaatacaccatctgagacacaccagatcagtgcccacgccatacctgttggccacttctttcaaagtctcgtcgagtgggcccgggatattccttgtgattggcgccagggcgccataagcggagatggtgatgtcccgcatattgtctcgtaggctgaagagatagtcgttgccatctcgaaccgagagatatgggtggaattcgagctgattcaccgagggtggtgtttgcgcggttgccaaaacggtccggagatgcgtcgactggaaattcgagacaccaatggttcgggccttcccactggccttgacctcctccatgcctttccaggccttctgcaggtcgtcgtcggattccgcccagtacggggtatgaatgagatacctgtagacagatcaaggctaggatcgataggagctatttctctgcaggggggaatgacttacgcgtcaacgtaatctaatttcaatttttggaggctgacatcaatcgacttggagatgttaaggaagtcactggagacctttgtcgtgatgaacagctcatctcttccctggacaatgccctccgcaatgctttcgtggatggccgcacccacttcgagctctgtattgtacatctcagcggtatcgaggtggcgatagccgacacggagggcttctttgacggcatccaccgtcggtcgatgcagggcatccgatccagaacgtttcaagaaagcagtgcccacgccaaatgcaagctaaaaaagcagtattccataagcaccatgcaattcaaaatgacaaaaaggatctggtagtacttactgtgggcattaagacgccatcattcagagaaagcttgtgcgacatggttcaaattcaccaatcagaaggtgatattctacttctagagctgggacgattcagtcaagcttctcaggccggagataagcaaactatttatcaccctgcaagccggaaccggcgcggtgccggaatacatgatcgcctgggccggcctttccccaagagtccattactcgcgaagctttaagacaccgcgcccttcaatgacagcattccgtggtgaaggtggaagcccataccatcatatatagcttcgattcggactagtaaacattccaggtgccaagtactgtctagagtcatactcccctgaacctgaaaattgccctgaacctgcagtggggaagtcttttgagccggaaaataaatatcaaaagaaaaccagaacagacgaatgaagtcactttcaccaagagaccgaccttataatttctcagagctattttgaacagagatacagataatactatttagagtaaattagatttcagattcagaccagcagtatcgactaactcgacccgtagatttgccacgtctagagtctagaccagatacatatactgtatccgtatcctacaaacagctttataaccctttttttgcataccaaaaaccccacagagattctactgaaattctgaatgcgagaataaatgttggggaccacgtcttccgtgctcctccggatgccctcgcttaatatcttgacatggctatatagctgctcaggatcccactagcatcctagaatccaggcttcttcccctttcccacaaataaacaagctcctgagtcctgagcgaagcgatagcaaaaatcaatacagaaagaatagattagacttaccgtatccgcatagacaagcctaccctaccaatctaggggataaagagctctcctacaacatggtaagaagaaaataatgagaatgtattaagctgattctcttctagatcggctctcgtgctactgatggcacaagttaggattgacacctctggctccaagatagctgcaagcccggactatctagtttgactgctatatcaatactcaaaaggggtaaaggaattcttttcttcttcccttctctattgagatgcctgcctatctgatgtggtgtatggtgttgaaattattctgattgaggagaggaagaagtctagataggcgcggaccatggtcctgatctaaatacatagggtcacgtgacttcggtagagatggctcaagccgtgtcactatcaggcctgtttcatgataataccttacattcctattcaatatacatgtgatattgacctttaaaaagacctttaagagctgaatattctaaaatagaaaataagaaaaagagatgtaagaaataaaactactctgtattccggacgtcggagccgggggatccgacatactacgttgtactgtggctgggcggctattgatatagaatacatgacagtaccatacagcttctccaaccagggcccggagttttcgggcttaaggcctgagtgcaggatctcgatcaactcaacattcgaagcaatatatattatatattattggactagaccaagctacatgcagtttggcttgcattacaacacagacacacgttccttaggcttgacatatgatcctcgccaagaaagtggctgacgatccacggatgggagtatcagacccaagagatccctccgcctggcgtgccttggattgtaggggtaaaaaccacggttggaagaccagcgtggaaatatagctacaactggaggcttttctgaacttctgggtgagatggtcagtaagaaaggtgggaatgtaccgggcaagcaagccgcaacaaatgtctcgcgctcgaaacaagtccatcgtcctatgacgtcaacacacgccggctgggaaaagaccccgcccggtgagacgagacataacttaacttctccaaagattgatcatatctttggagttctgattctatcttgcttcatattgatccatctgacaccaaagcttcttgtattcccatcaaatcaaatacagtcacgatcatgagcagctataaattccccgtcgacctcaagcagttcaagcagctcaagcttgacccaaaaagcccacagctttctgctcagcagaagaacgacctcctgcataacatcaacattttcagagatgcaatcatcgcattcacggccacgggtgccgcccgtggactcgcgggccacactgggggtccgttcgacactgccccagaggtctgcatcttgctcgccttcatgaacgcgaaccccgatggtttcgttgatgccctgtacgacgaagctggccatcgggttgccacgcaatacttgcttgctgcgctggacggaaagattgaccccgaccacctgctgaactaccgcgctgccgattcgaaactcccgggccaccctgagcttggcctgacgccgggcatcaagttcagctcgggtcgtcttggtcacatgtgggccatgtgcaacggtatctccatggcccacaaggataagaacgtcctgctgctgggatcggatggctcccagcaggaaggaaacgacgccgaggccgcgcgcattgccgttgccaaaaacctgaaggtgaagctgttcatcgacaacaacgacgtcacaatcgccggacatccttcgatatacttgaagggctacgagatcgctcgtacgctcgaggggcacggcttgaaggtcatccgcgcccagggtgagaatctggattcgctttacggggcgatgtgtgaaatcatcaactacaacggccctgccgctgttgtggtagaccggaagatggccgcaggcatcgaagaaattgagggagagacccacgctcacgatgtcattccggtcgatatcgctcgcaaataccttaccaagcgtggatacagcaaggagcagcttgctttctacgaccagatcaagcctggatcgaacccgcaccagtaccagggctcaaccaaggagaagggtgcgaaccgtgcgatttttggtgaagccgtgaactccgtgctcgacggcctcagcaaggaagagcgtgtccgtcgggtcatggtcatcgattctgaccttgcgggctctaccggcctgaaggcaattcaatcgaagcaccccgaggtgttcgttgcatccggtgtcatggagcggggcaacttctccgccgctgctggcttcggattcggcagcaacggcgagcgtcagggtgttttctctactttctcggctttcctggagatgtgcgtctcggaaattaccatggcacgcttgaatcgctgcaccgtcctctcccacttctcccacagcggtgttgatgagatggccgacaacacctgccactttggtctgaatctcttctttgcagacaacggcctgatggatgccgagagcacatcgttgtacttccccgccgacggtgagcagatgaaggcggtcgtcaacaaggtcttttgggataagagcatgcgtttcatcttctcaacgcgttccaaggttccttacatcctcaaagaaggtaccgaccagaagctctatggcgacggctacgagtttgtcccgggcaaggaagaagtcatccgcaagggttccgccggctatgttgtctcgtacggtgatatgctctaccgctcgctcgatgccgttgagcgcctgcgcaaggagggccttgatgttggcctcatcaataagcccacactgaatattgtcgatgaggacaccatcaaggtttacggatcgactccgttcgttgtggtcgtcgagtcaattgctcagaagacgggtcttggctcccgcctgggcagtcaccttcttgagcgcaagcttacgcccaagttcaaggcgattggtgccgtgagggagggctctggcggcttgtacgagcagattaatgcccagggtcttggaccaaacgacatcattgcggcagtgaaggaggtcagtgggaaataaatctgccatccttcatgaaaataatgacttctgagaatgattttctctttattaaattgactctatcaagattgtcatgaagttatttctgtaatttttatttttattttagctagtagactactatctgcaggtggatcttctcttctcccatgtttctaccagtagaagatcacaatatcgaaagaagtagaaaattagaaatatgtaagaaaaatatcccaagtcacgttttctggcgaccacaccagtaccacttcccggtgaattattttcctgccgttgttctccccttagatgattggagggcattggaactgctgataaacttagaccagctctcatatacttgataaacatattatatataggagattactttatatatcctataaccgttaatcatgcaatcatacctacttgaccatattcttagcttatccagttcagtaaccatcaatagggatcatgtcttcccccatgaagggcaaaaaggcagagggagagcaatcccctcaacaacctcccccgcccgcaccagaagacatccaatcgaagaatcccccccccccccccacccccttgttgtaaagctgagaaatacaccccccaggccattcccaccaaccgccaatacctgtgctctagtagtcgatctatttcaagtcccgtaccgcgcccatacccatacttcttttccggcacattaacggatcccctccatgcctctctcagagagattctcgatccgcccgaggaacctgaaactccgagctgcaatttttttatgtgctacaagtgtagaggaaactgtggggttgatatctagccttacttgacccccctcccaggtcaattgttgaaggagctgcatactgtgttttcgaacagtggaagacggagtcccgattccaaaaaaaaaaaaaaaaaaaggcccagcctgatccaataaccgctatgcacctcgcccaactatattctccacaaaccttccgttacactaaccccgataaattttggctacttttgtgtaaaagaaaatgcccggacttgactgggcgtattactagacgacgtggtatactagtcaaaaaagaacatccggggccattttctcacgtgtacggtgctggtctttttttctggggttctctgaaggggcgccgtggcattggaggtatggtatccccgaaccaatgcaaaagtggctggacggtacagtacatggagtgggtttatttatactgggaatggctttttatcccccttgtcgggcaagaaactcttgtcattttagcatcggtttttttttttttttctggttgcgcatgggtcccgatttcaattgatgaccccacatccaagcgagcttgattcctctataaaaatttatagtaaccgagcggtgagaataatagactagtaagagggaaggtctagaattttacttggactatattgatatatgcttggggaagattattggacagtatccctgatctctatattcaacaaatacaatccaagacagtagatctgaacactggagcatgtatctggctcgtgtgtggatcggatctcaattatactcctccatggaggtgtccaccacacatccatcagtcgacatgccatccgatcttttcgcgtcgccgcttcatcatcaccttgccctggaaagaaggcatgacggcggtgacgaggatctcattccggggtggcgggaccccctcctggaacttgaggtcgtagttgagcagcaagtagatgaggatcatcttgatctcaaaggcggcaaagaagcggccgggacaggcgtgggtgccaaaaccaaacgagagttcactcgtgctgcatgtgctcttagtagggggtcattcattgcgaagaaggaataggatgggggttgaaaaaagagctcacctggtcgacacgagctggtgcaggttccgctgctgcggctgcaggcgcatccgctcgtaccggaaggcgtcgaactggtccggattccccaggacggactcgtcgctcgtggcatcgtagttggaggtggccacgaagaggcccttgggcaggatggtgccgttgctcatggggatgtcgctcatgatcttgcgggacatgacgataagccccggcgggcagaaccgctgggattccttgcagaagctgtccagcttgttgcacttggtcaggagctgcttgtcgatctggccgttcgtctcccggagcagcggcaggaactcctggcgcagcggctcgatgcactcgggatgggcggccaggtcgaagatgcagtgggtcaggttgtgagcggtggtgtgtatcgagacgatgctcagcgtgagctgctgctggacgaggaagtcgatatcctcgcgctccgccggggtacagttatgcagcacccactgcatcatgtcgttggggggcttgaagtccgggcgcttcaggtcggccagccgctgctcgaggatgggacgcaccagggcgctggcctccttgcgctgcttctccaactctttcgactggggcgcaaagcgctggaggatcggccgcagcaggaagggatacggccacagggcccgcgcggcggccttactgaggatggtgtagcggatcatgatctccagccagcgctcgttgcgactgagcggcaggccgacaaaggtgcggctgctcagcagggcgatgagctgcaggtccgtgggatagacggtgatgggcgtccagtccacgcagggcccgatgtgcttgtcgaccgcgtagacggtctcatccagcagcaggggaaaggagcgcgcagtgtgacgggtcagctcgttcttggtggtctcgatggtgacatggtcgacgagggcgatcggattgcccttgccccagcgatacagccgttcggcttcgaacgagatgtggctctcgggcagcgacttgagctcctcccaccatttccgggggaggatgaccgtaggatgatggggcgtgttgaggatgaagggttgattgcggtactgcagtctcgtcaggattcatccatcatgatcgagccacgatgacagaaagtcactcaccttggctttgccctcctgcagagccgcgaggaatcctttggcgtgagacaccacgggggcatcgaacgggggaattcggttctggatggagacggtgaggaagtacaggacgaccaggacgacgccggtgcccaacaacgagggcgccagagagggcgcatccagctctttcagcagatccatgtcgggagaggctcttcagatcaattcactgcggacaatcttcgatcctggacggcgtggagaggcggaccaaagacaagacccatctccatcgatccaatctcatcctcgatggattaatatactccatccctttcgcacaggcggactgtttctccggtcgcagcagcagactgaatgaatgtccccagaaaagtcaccgcggcgcgatgcaaatcccaagccagccgacatgggggccatgtcgatccatctactagagtagtatctgttggggatgcaaagatacggcggggactttgatggccatgaatgacgactcagcatcgagggttcatcggcaaatcgacgagaactgagttcactcattcatcgcaggaccgggggtcgttctttgcggaaccggaagagcatcacatcacccgtgcctttgttcacgataccttttactctgttcatctgcgaaggtggcaagacagcaagcaaccacctccacctccaccaccttcaccacctcgttgatatgtcggcagaagcagagaagcagtcctcctctccggccgactccagcctccagaccatccatgatgaccgcgaccaacccccgggcgatgcggaggatccgaccctcatcacctgggatggacccgacgacccagccaaccccaagaactggtcccggcggcgtaaatgggcggcgacgatggtcgtgtccggcttcaacttcatctcgccgctggccagcgccatgatcgccccgtgtttgcccgcgctggctgccgagctggacatcacctcctccgtcgagcagagcatggcgctcagcgtcttcgtcctgggctacgcggtcggcccgctcgtggtcggtcccttgtccgagctgtacgggcgcgtgcccgtgttgcagacgagcaacctggtgtttctgctgttcaacctcgcctgtggcctggcccggaccaagggcgagatgatcgccttccgcttcatcgccggcctggggggctccgcgccccaggccaccggcggcggcgtcctgggggatctctgggccaccgaggagcgtggccgcgcgctggccttctacagcctggcgccgctgctggggccggccgttgggcccatcgcgggcggcttcgtcgcggagaatacgagctggcgctggatcttctacgccaccaccatctccaacggggtcgtcatgctgctgggcttcctcctcctgcaggagacccgggcctccgtcctgctggagcgcaagaagcgccgccgcatccgtgagaccggcagcaaggcgtggcataccgagactgataacccggatcacaccctgcgcaacatcatcctgaccgcgctcaaccggcccttccgcctgctcttcacccagccgatcgtgcaggtgctggccgtgtacctggcctacatctacggcatcgtgtacttggtgctcgccagtttcccggatctctggacctcccccgatcactacggtgagtcggtcggcatcggcggactgaactacatcgccctcgcgtgtgggttcttgctgggcgcctatctgtgtgcgcccacgcaggaccggatctaccgtcggttgaaggatcgcaacggcggcgtgggccggccggaataccgcatcccgctgatgatccccagtgccatcctcgtgcccgtcggtcttttcatctacggctggaccgccgagtaccgaacgttctggatcggcccggacatcggcatcgccctgtatgccgcgggctacatcaccagcttccagtgcgtccaggtctatatcgtcgacacgtacaccaattatgcggcatcggcgctggcctcggtgaccgtgctgcgcagtctctgtgccttcacctttccgctgtttgccccgaagatgtatgatgcgctggggtatggctggggaaactcgatgctggccttcatcgccatggggctcggatggccgggtccgtttgtgttgtggcgctatgggcaggctctgcgagagcgcagtccatatgccgcagagatataattccagtcatgacagaattcagactcaaaaacagtgtcaatagtgatggtgaaaaaaggataggcggatgtatatactcgtcaagtttctgtcgtaataaaataaagcaatggctctaagaagaagcttcgttttggcagtctcatgcatctactggtattgctgtattaaagtccaactactgagatgatataatcatgatacctgactctggttctggtcaataagagagagtatatatatatattgtcgtagattcaggcacggaagcatagtaagaaaacaactaattgcttaaagcttgcttgaggactagaatacatggaatctaggccatatgtcgtaaaataaggcacggaagcatagaaagtagctgacgctctattctgtgaaaaacagtcaaattgctcagaggactagaatgcaccgagatctaacagcttatttaagctaatcataaaacaaagcaacaggatctaatagcaagcgagctgtaatcaagcggggataaatcaaacaggttcaaagaggccaaacggggtcaaaacaccaaacgatgatgtttcgggatctagctggcgccagcagcgaaccatgcaatatggccgcttgcgccgacaaagagtcatattgtatttactggagtctacagtagccaatagcgacgcaggagttttggacagattctgcatatattcttcccattctccctcgcatcaccgcttgattatgaatttatctgctccgttcagcggtcaagaaagtattgttttagcattttatagatcttctaggatttctgctcagtactaaagtaagaacagcaaaaaataaaagataaaaataaaaataaagaaagaaagaaaaataaagtaaaagcttaatggaaacaataataattagactattcgagatatagatctatattgagtgaattttatatcctccattcacacccccagtagtcagctgccaaaatacatatcaatgctaagttctgttagcagctacagtcgagataaacgtactgcatccgcattcaaaccataaagataatcttctcaatgcttgaaaacaagaatttgacctccgcccgttctcaaggttatcgagcaggttccacttactggggtcataggaaaattaaactgggaataaagtaagagtaagttcggtttctagcgtttatcatctactgaaaaattgctggcaatccgcattcataattcttcatcacgactcaaaacgttaaagatgctgctcaaaaaactccgcggcggtcttgtacccatcttcaaacgccttgcggaccgtctcgtccttcagattggcacgggcggccatccagccgtggatctggtccggatacgactttaccaggcctgtcttgccgggaccctcgaggaccttcttgcactcggccaccgcggtggcatcttcgtccttcgacgccaggatgatatgggggatgttgatcttggagacatcgtcggccgagagcattctgcaacaccccccatggttagtgtcgattgagatctcaaagggaaatggtcaagggacttgccctgggtgcgtctggccggatgtcttgaaaatggtcccttcacctgacgtcaacgcgaccatcttgcctccccagcagtagccgaacgcgccccatttgccgctcacgctgggatactgcgtcgagagctgctggacgagttccttcatcggttcgatatgcacggcaaagttgcccgccgtggcaaaccagtcgccaatggcctggaccagaaatcagctggagattcgcatacagcgttcaagtcggacatacggccttcttttcttcggtgtccggggggaaccaggactcggaggccaccttgcccttgaagaagtccgggaccaccaccagggcattcagcgacgccgccaggatatcggcgccctgcaggagctggggcgagtatccaaaggcgtcgtatatcagcaaaagggcgcgagaggcgtcggacggaccagtgatgtctacatcctccgtcagaaaagagtgttaggcgggacatttcgcagatgtgtgtcgcaaatggggatcggtaagtatatacgtacatgtcttcgtgtccagcaccgtttcatatctgcccttcgcttggtagtcgtcgaccaccgcgacgggcaggcagagacaggctttgttgtgtccggacatggtgttgagggggagggggagtgtcagtttgtctccaagaagaaagcgggggagaattgggcactatttatctctatctgataagttagcgcccgccccgccgatcgagttcgagagaccgcaattggcgtaaagaatccgttgccggcgtctatcacatccacctattatattggcagcggaggcttttttcgagtccgaatcggccccatctaggattctacttgactacggtatagttatcgcatgaggggatctgcagatacagggctgaaacaacagtaaatttggtactctcatttatatgatttgttagagtcatattctccccattcaagtcatcatcggccatttttctctcttctccctccgccatgtcggccctttcctccacaccagcatcagcatgggcaacaggccgatatagacggcgcatatcaccgtccccatccatccgatcccgatcgcctcgacggccggccccatcacggccaccgccagcgcccccatccagcaccgcaccagattattcgccgccgtcgcggtcgccggcgtgtccagatgcagatcgacgatgaggaccgagatcgagttggtcgagctgctgaccgtccagcccaccacgaacagcgccaccagcggcacggccagaggggtgcgcgcttgcatcgtccagccgtacaccagcaccgacagggcgccgaccccgacaatcggcatgccgacctgcagccgcgccttttcgatcgggaactgggacagatcctgctggcggccctggcggaggtccaggtggtggatgcgcgccaagcgccggaagttccagtcgacgatgtggccggtcgtgagggtcgccaggaaagccccggcgccgaagggcaggaagcacaagcccacctggaaggtgttgaaggcgtactgcgccgagagtgcctccgacagattcgcggacaccatttggtacccggccagcacgcagccggcgtagatcaggatcaggctggtttcccggtcggcgatcacgcggagggatccggtcgggctggccttgcgtccgggtcgaatggctgctggactcgtggagatggtcatcggggggccgtttaggggtatttgtcgtcggtgtcgatatgccagccaggacatatggatccaggtgggagggggaatcgagccatctcccacgacggcgcgacaggtctcgggcaggcaggcgagcatgaggagaaagacgacgcccgcgaagatggccaggaaccaaaagaccgaccgccagccaaacgactggatcagcatgcctccgatcaacggtcccacagccgggcccaggatggccccggaggtgacatagctgatataacggcctcgttcggcggaggtcgccatgtccgcaacgactgcctgggccagggacaccaacggactgctgcccgcgctctggaccattcgcaggatcagtaaagccacgtagttggtctggagggccagtccaatgttggatccaatgtagatgacgaagcacgcgatgtagagcggccgtcgccccgctcgatcggaccagctcccaatgaaggagggcgccagcccttgcatgacctggggaagtcggtcagcgggagaacaatagagggatcatgtagggtcctacgttaccagatacgtggtcacggtgaggttgatcaacgagacagacactccgagggcatcggccaaggtgcccagcgccgggaagtaaatggccgacgaaaccggggagaagaaggcagccagggaggcgatgatgacgatcaggatcttttgtggccgtgtgaaaatgctatgtgctttcagctcatcttggggtggcttgaagtctgggacgatggccccctgggatgattttgggcactggtcctccccgagaaggggagtggtctcgctggcggagggcatggcgaagcgcctcagggcagatgtcaacaatagatacactgcgggcgatacttggagctgttgatcgattctttatatagactagagtagggagcagtagtccaaggagccacgctgataacaggactcgtggtacatccccagagctgattcagttttccaatggaatacaatcaatggggcttgattatttgtgggtttctctacttttagtgggttggaatttaatcttctgccggtcaggggccgttgattcatttcggccaattaagtgtcttcaatcatccccagcttcggagggttttgatctcgtgcaatatcagaccgcgggaggttcctgttttaatcagttcttcttatctattttttttttttgtctctcaattgatgacttcatcgcttgagtaaaataaagtagtacttttctcgcttattttatgttaatctttcatgtcagatcgtatattgatattcactacacacaatctgcttctccgttaccgtatagacagatataaacaaatgggttgaccctgtatgcatcatgaacctcgtcagtctctttctcaccgtcgccttcatcccctctgcattggcccagtcgtactatccacccgtaccggccggcaccaccgtggtcaactcgacccagtatcccaatgcgagcattgagtacaaagaggtgagatttccatgccttctggatctcgtaggtacttaaagttggtgtctatagaccacgatctgcgagaccacccccggagtcaaggggtacagcggatatgtccggctccccagcgatgttgtgaacagcgtgaatggaccgcacacgtccaattacttcttctggttcttcgaggcgcgtcacgatccggacaaggctcccctggccatctatctcgacggcggaccggggttgagctcgctgcagggggctttcaccgagacgggaccctgctatgtcaacgaggactccaacagcacccgactcaatccgtggtcgtggaataaccatgtcaacatgctctacattgaccagcccctgtccacgggcttttcctatgatattctggtgaatggcacgttcgactcgctacgcgacaaacagccggccaccgagcactcgatcaaccctctggctgacgaggacgagcctgtggccaacaacacctattttgttgggaccttctcggggcagaaccccggtgagacggccaactctaccgccaacggcgcggtgggcatttggacctttttgcaaacttggctctccgagtacgcctgtcttcgagggtaactttcgcaacgacagctgacgtatgggatcagatttccggaatatcggacgaaggatgatcgaatcagtctatggggtgaagcggtgagtgactgatttggaagtctaattgcagaccagtgcggcgtctctgacggttatgcatataaacatgaagtttgccgggcaattcgctaccatctacgccgagtactttgaagtccaaaatgagcggattcgaaatggcagccttcgacgcgattccaactcgcccgagagtccccggatcatccccgtggacaccgtcgggctcatcaacggttggatagacatgtttcgccaggccgccggctacctaaccctccccttcaacaacacctacggactgcaggtggccaatgcgagcgttcagcgtcagatcacggacgcgtactaccggccgggcggatgcgtggaccagacgcagaaatgccagacggccgccgcagagtcagatccgaagaatcgcgcgcacaacgcgacggtcaatgagctctgcttccagtccgcctacctctgcacgaccaccgtccgaggtcccattgcggcgacacaggtatgttgcgaggagcaagaggtcacggcacagaactgactggggagcagtacaatacgttcgacatgggccattggaaccccgatccatttcccccgagctattacattggctatctcaaccaacgctgggtccaggaggctctgggagtccccctcaactttaccgcacactcatcgttggtcaccatgtgtatgtgtctccccagcggttatcgaaagctctacacaaggctcacaggccagtagcattcctcaaaagcggcgcgtttgccctcccctgggcgcttcaggatctgggaaagcttctcgatcgcggggtgcaggtgacgatgatgtacggtgatcgtgatatggacgtgagctgtaagtattccctttctttgtgcaatgaattggtaattgatgggagtcaatagggatcggtggtgaggaagtcagcctggccatcgatcattcctcggccgcggaattcgccgccagtggatatgagagtatctccgtcaatgcaggctatatcggcggcgtaacacggcaatatgggcgactgtccttttcccgcgtctttgaagcagcgaatagaggtattcattcccaccgtgctatctcatactgttcactatgctgatggcgatggcggccaaatcgcagtgccctcgtaccaaccggaaaccgcctatcaaatcttcatgcgcgccatctttgggaaggacatcgccaccgggtcgacagtcgtcgatgcccgctatgcctcgaccgggccatcatccagcgggcatatccgcaacggactgcccgtggccccgccccccgagtgctatatctgggccccggcgacatgcacgccggcgcagctgaagtcactcggggacgggtcggcggtcgtccgtgattatattgtggtcgagtggtgagcattcaagaggtatcaatgaaacgtcattatcattatcaataagaagcatatatatacatgacttcaggcagctacatgtatatatacatcagtcttcgtgtatatatatcagggtcatgatgagactggcgcgtaagtgaaaataatcacaaggttaatagaaagtcatgcctcatattcaaggtcttccaatccagtctttacccttgccacagctccagccggccgatgaccgactgcaggcgtcgacgattctccgacaccagattgaaccccgtctgtgagatggacgtctgcggcgcctggagcatgcgctgctgcagctgctgcaagaccgaggagagccggcgcaggcgcttgcagagaaactgcttgaagaaatggatcttctcttcggcttggatctcgaacgcgcccgccaacagccgccggctgttcatgagccccgacagactgttgttcgacgcccgagacccctgactgctgccgccgctgctgacgctggcgctgtcgcacgcgccacacgacgaccgccgggaaccagccaggagcgaggaggcggcgcccgggcggatgagcgtcagattgaacttggacacgctctccagcatgcccacggtgttgtcgatcttcagcgccaccagcaggaggaggtccgggcgactgccggaacatccctggcactgcaggacctgcgccgcctgccggtgggcgctctgctccagggccacgagcatgtcgatcgagcacgccagtcccagcgaggtgcggcgatcgaaatcccccaggctggccagcaccgactgatagcattcgcagtgccgggccggcggcgccgatgggagacgctgcggcctcggcgccgacccctcgggatggctgtccgccggcatggacatcgggtagccgacccctggctcctccggggccggcggaggcagtccggggcccgccgacgactcgaagggcggagggttctcgaggaacaggaaggcatcccccatcggagccgccgccgatttgaacgattcaaggaaggatgggggctcggtgccgggcggacaggggccctggtcactgggggccatggacgcaccggcggtcattccgctcagcgtcggcccgtcgaagtccaggatagactccagatcgaatgcggggggtcccgaggggtcccccgcggggtcatgattcgagccatccatctccagccaggcgtcgtcatccatcctggcggcggcggccgggccgtgcccgagcagaaaggcatgatcgtatgaggaggaagacgagaaggaatcgaccgcacggtggctgatggagatggatgccgtcgtcgggggcaatggaggctcggcgggactgccttcggaggcgtgtgtggacgccgtgttgttgccctggaaggcacggtttttgctcctcttgggggtcttctctctctcggccgcgtcgccggggggtttccgccgcggcggacgtccaatgcgtcgcagggcactgtacacgcagggaactttgttgtacttgcagtgttggcacggctgttcgcgcgagcaccgatgtttggccttctggcaggcgtcacacgtggagcgcagtttcaccggctcgccgggcttgcttgccgtttcgccagggctgggcggatgtgggaaggatgaggatggcatggacggcggagaaagagccgactctacataggatggatgttggtagatactcgggtgtggattggaaggctggatcgtacgatccggcaagctacatactagtattgctgacgagagaaacgcagaagagatatagttaacacggataaaagagaacctcgataaccctcaatcgcagtacccccgcatgttccccgcctctcatcttcacgattggcccagccagttgggggctgaaaggagtcattgacgtcaattctgcatgctctacatgctggaaggattcggcgtcagctgcagatcgcataaactggttgtgtagcatccatcacatacttaaaaagcagtccagacacaacaaacgcagtaagaaggtaagaagagtgtgtatcaattcccctccgggcagtggccaggccctcttcggagtgtctccgacagtaacccatccgggtaagagataagcttcatcggacctaataggtgaagtatatctaaaacacggctctgtcgatctcgcgaaaagcccgcggtgggttttgaggctggtttcggccacgcaatcctcaacgaatctcttgttggccaagagccattagttcccaccaaattcctcagatgtcacctaaaccttgattatttcctcagatgccatcctgcacgctcctggtatgatccacctgtattcggacagtaagagggctcgatgtggttttatgcaataaacaagcctttcatcatttgctatactgaaatagcttaaaaggaggccattgactctttataaagatcagtattttattactcctttttcgaataggggttgtttcagcttctagtagctgtacttaaatataaaaaaatacatgattttagagttgtctgcacagacgtacatacctcctgtacgataacagcgattattccccgattcggcatatcaaaaacgcgcggcacgggggaatttaatttgggtttgggtggtatccggggaaccaggcgcattggttcgtcgtgttaggagctccgccgatcagcgggagtctcggacgataggcagggggcggtagtgcttacagtcttcatggacatgtagtgacgagtgtgccaagcaccacagctatataaacatacttttggccccctactgggttcttgcagactcctctccgcagaagcttgttcggccccggaatcatattccccgtcctttgttggcagatcgacccggtccaggcatatatatcggtgccaaaaagaccccgaaggccccgatgttgaccaaaaaggattttaggtgcagccagccacttccgcccatgtatccgttggtaattgctagcggaaggagtccacgacgcaagagcagtggatcaggttgatcatggctgattatcgccaattatcaatggaaaagaatcctgctggtcaattgcctccattgtcttcggatatgagccggtgcggcgtgtttttctgcacacaaatcatgccgaatcatctctggcgaactcgatgattccgtgatgcattatcttgtttctccaacaccacaagaaatcgccgctctgcgccgagatataatctctgaaccggcgtccgagtatccgaatggataggtaactcacctccagtccttacagagacatcctctggcggataccctccacaatgcatttcaatcttctcctcgtcttgaccgtcctcctccgccaggctacggcactcgtcctgccgccgtccaacagcacctccaattcgaccggcaaattctccgcccgcaccgtcttccagttcccccagggatactggctggagaatctggccgtccggggcaatggccaggtcctcgcaaccacctacatgccgtcggccggcctgtatctcatcgaccccactcccaatgccagctatcccgcggtcctcgtccaccagttcgagaactcgacctcggccctgggcatcgtggaggcggaggggacagagcccgacaccttctatctggcgacgctgaacttctccgccgcggacggcttcgtcccccgcaccagccaggtctggcgagtggacatgtcctcgttccactactcaccccagaccgggcaggtctccgggaaggcggccgtctcgcatgttacgacgctgtcgtcggtgggcatggccaacggtatgaccctgctggctccggactcgtcgcacatcctgatcgcggactcccttcggggcgccatctgggacctggacaccgcgacgggccactatggcctctcgtcgtccttccccgccatgcggtccgacaatccggcgcgccgcttcctcgggatcgacggagtcaaggtgcaccagggcagcctgtatttcaacaatgcgggtgaattcaccctcgcccgcatgcccatccacagcgatggcatcgccaagggggagccggtcgtcctggccacggacctctacagcgatgggttctgtctgtacgacgccgacacggtgctggtgacgatgaacatcgacaacggcctcgccgcgctggacctggagagccatcgccggtggatggtggccggcaacatgcccgacggggtctttacgactccaacgtcggtcgagctgggccgcggggaggacgcgggcaaactcgcctacgtgaccatgggaggcacctacgtggcgaccggtgccgaggatctcgtcgggggcagcttagtcgtggtggacctgaagtcggccacgaccgatccgaaaggaacgggaagaggtgggctgctggtgcaggagacagagacgatttggttggagctgtagagagggggttcagtgctagaacattcagatgtactcgagtagtggtttatcatcttgaaaatagcaagctgtctactcatatatgtagtccagtatagggagagtttaaagaatgggagatatcattattaaaactgaacgataccagatacaaaaaatcattttgacccaaagtgcatcaaggtacgtcgacgtgttcctatatacatgttcctatacacatgggtcgcccgtaggcactggaaatacaaatttcacctctggcctgaaagaccctaagaaggaaaaatcatatacagagttttccgccctataaataataccttaaaggagctttcaagatgtgtccaaacacagtacccatcccctgctggtcatagcttcgccgacggcgccgtcatctcgagcactggttcggtctcccccgtgtagacgtgcgtgggccggaagaggcggattttgtttttcactgcgggcattttatcagctctcttgcccttgcttgaaagttggaaatcggctggacctacacatggactcccgataatgcgccaggatgcccaccaaccgctgtgctaccattgcaaccgggatttcctccggttggaatcccctacgacccgaccggtcaattgtcatccactgcaatcaacagaaaaacaacttacaggcgattaaagaaaaaggttccgtaaaagtccgcgttcgcatgcagttttcgtttgatgaaatactcatcggtcgacgagaggcgatcgatctcccgcgccaccttgaccagcggatccgagtccccgtccagctcgctgaagagcatatctttgatgggcttcacccgggggtcgatcgtcgtgtacgtgcgatggccgtacccaaacagccgccgcttgccagacttgacctcctccagaaaagccggcacctggtcgacgctgccgaccgcttggatggttttgtattccgcctccggggcgccaaagtgcaggggcccgtacgcagccaccagggagctgatgaggcccgagatgggatccgtcagcgaggaggcggttaccaccatcgcaaacgaggacagcgccatgccgtgctcggagttgagcgccgcaaaccgccggaagcaggacagcttcaccgggtctggacgaccggtgtacggttcaaccaggcccatcatgatgaacaggttctcaaagtaggtgttatccgtcgtggccggcgtgaaggcgatgccgcgacggtggctggccgccatgcccatcaccaccgcgtaggcggctgccgtccggagaatggcacggtcagtctgttcgggatttccatggtagatgttgcccccggcacaggctgggatggagtcggcatggtgggccagatacgcggacagcccggccacaatcatgggcatcggggggcttgtcggactgcagggggttcagttcttcattcattcaaggtgatcgtgatggacgatgaaaagcacagtagaagacctacgggaatgtctcaatcacctccgcgacatgtttgggcgtggtcgacatgagcgtggccaaggtcagacgcaacgcctctcgctgagacggcgtgggatatttgccccagaccaagagatgcagcatgtcctcgaactcggcctgccatagttgctccagggcatagccccgaaaaagcaacagcccgcgatgtccgtccctaaattgagcattagtgaaataaagaaccttcccccgggggggaactctcttggacccgttccctacgtatatgtcatgttggtctccaccacgcaggtgttcttgagacccggatcaaagacccgcaggccatcgcccactttgtccgctcgatccgcgcccaccggggacgccttgatctgcttgagatcggtggcgaggacggtgttgcgccggatggggatctcatactcccgcgatgtgcgggagtctcggatatgtagagctccatgcgacatggtgaagctgcattcatgatggatgcatgctgcattacaatttctatatatattcgacagatgatattcctcgtttatccccaggaattggtggaagcctccgtgttcatcattatcggggagttctcgtgatgtgatttcctaatgccacatgttccaatcctgtgaatgccccggaatgttgctctgccaatgagaaaatcgccgccagcgtttcaatggtggcccgggatgtagaagagcatttgaaatctcggcatttccttttcccaagaaaaagaccgagtccgccgggttctttttcgaaggaatgtgagcattgctgctgccggttcccaggtttctctgcaaagaccctttctttatactatctggaagaaatagtacgatctgttgtttctctgatgtgatctgtagctttggaacctaaatattcaaagaagaagaaaaaagaattaccttctttttctctgccttctactgccttcctgcgtagtctttctttcctttttgcagtgagtttgctaaatattcccgggatatgtttccgttacggaacgaggacgaaatacgtggctttacgaaccaacatgaaaaaggaactccgaggttgacggcaccaaatttccctcgtgacagtgcgataattatttcagtgagcatcaatacggagaaatagacccatgccaagtacaagtgtagtttttaagcgaaatcaatgctattccggtaatctctactttatagacaaaacaaacagcacaaatacaccatatactcacaggagcgtcaaagatcgaagtcaacagcatactcagtacttgatagggaatgaatacaacatcttttcagccgacctttgacgtagcgtcattatggctctctatattctattcacctttttattttccgctaacaatacttgaagctggcattcatcgtctaggcttgactagcttataccatacgaaaccagatctatcgacttttagatatcagtatgaggaaatcaaaagcaaagaaaagtaaagtctcaattgtttttactattaaactgttctttaccaggtagccttttgcaagtgatcatcagattcaacacccgtggttcttgatatctagccatgacttgagaaaaatatcagcacgctagtctccatctgatacgtaagtccctttagactagggatttgttgaaccttctgttactgaaggcaagtaaatcgcggatgatggatctgttttggtcaacatagaatggtatgttcgctcactccaggctgaaaaccagactctactgctctcgagaccaggcccactattcaatcgtcaagaacctccggtcccatttatctgaggatcaaatgcagtagcaacagacgacggcagtgtgggagtttcagagagttctgatcattgtcctgctagcctggctgctgatgctgtagacggatgagtctggtcgaggtcatgcccacacctccatatcagcacgatatagtgaccgcggagggatactttaggtccctaactccgttcaggtccgagagggcctccgcatgacgccgtcgatatcaagtcaccgttccctcctcattgcccatcctagggtccccgatataagggcaacgagcggtcagtagactctatagagttcagccatccactactttctctacatccacaacatccccatcgagtattccatcatggcctccaaggaaactttcagcaaataccctgccttccccgacaacatccccacggcggcggtccccaagatctccctccgccagattttgtcccgcgaccccaccgtgtcgaagcgtctggtcgacgcgggcaaggaattcggctgcttcaaggtcgacctgaccgatgccatcgacggccctgtcctctgtcagggcgtcgagcgcggctttgacctgggcaaggccttcttcgaccaagacatcgagaccaagaaggcatacaagctgagtcacgagaacgtcgggtaggtttctccccagccgacgtcggcccagatgatactcacccacgggtgcacaggtacaagcaggccggcgttctggtcattaccaaggagcggcgagaccaggtcgagacatgctccgtctcgcgcgatgatctggcggccagccgacccgacctgccctctgtgttcgaccagcagcggctgctgctccagggcctcgttgcgcagctcgggcagctctcgcacctggccgtctaccatctgtcggagggtctggggctggattatggagtcgtgtcggcgcgccatgatccccgcgaccagtccgccacgatgatccgtttcctgcataatccgccgcagagaggaccgcgcgaggagctgccctcgaccgaggacccgggttcgcgggcctacctgatgggccacagcgacgggggcacggtgaccatcctgttcaacgtcctgggtggactgcagctccagcgccagcagcccgatggctccatcgagtggcagtacattccgcccgagcccggctgtgccttgatcatggtgggcgacgccttcaagtccttcacggacggggaagtcccctcgtgcgtgcaccgggtcatccagccgccgggcgagcaggatcgcttcgatcggtatgcgctgggcttcttcctcaagcccgccaacggggcctccattggaccagtgccgcgccggggcgtgacggagaatggcgtcaacaaggcgtcggactatggagagtgggcaaagaacaagaacgcggcgttgtacaacgagatgcgccaggagaatgtggcaatttagatgagccagacccgacttgaagcgatagagtgatgtagtaagaggggagaaagacaatgatgcgttaaacgtaactgagatgtctacccttttgtctagaagtaggcctgtggcattcaagacggatgttgtctgtagttttgtctcggaaagtatgaacacgctaatcgccctattatcttcggattagctgcactcgggaaattcccgacctcaaactttcagcggcatttatcctggcataagaatatccagcaacactatcatgaggtatagtctgacttgcagaatgccaatgacggtatctagcaagtacagaaaaggtacgattgggaaaaccaccgatattgtgacgccgcggtctcaccgttgaacagcggaatcctccacgcctacgaaaagccccttgccggagggttggtcgagcgcgacagggtatagcgagggataggcgccttaattgaatccactaccgagccttttagctagacccaggcttcttcaaacccagcttcttgtgtagctgtacggagacgcttctcctggtcaacatcatgtccagtctgcctttctagctgcttcaccaaaagcatccttgatggcattgttaaatggcaattcgtgaggtcattttctgcagttactgcgatgcggatctggtgtgttataagatggtctctcgaaatcgtacagaggccggtgtacctgcataggaggtacagtgcttgcagtagtaaatctcttgcttatgcttgtttctcgttgcatgctcactctcctttggtggctgtgtatgctgccatcagagatcattggagtgtttctttttgcgaaaaggctcagcaggttcaacagaagatgcaggttcggttcctgggctttcagtaaccacagtacggttagagaccaagccaacaagatcgaatttagcataggaagtagtgttggaccttgtgttaatatgtggcaaacaatggaattgggccttttcaatgtagaagagcggaggtgaggggtaaagtcaacaacaagttaacaactattgtagtgaaagtagacttgttcgtggggcgggtccggtccggtcaggcgaaccgaagttaccgaaccttcttttaacccggccaagtcagctcaagacctggatgggcaattctctaacctaatctagaaagaatctctagggtcccgaggtcgggtcggatcaaaggggcggatcaccgattttgacgccgcgtcccgagccggggtcgggttaacaagtgtaaattgttaaacctaaaattgaaacagattataacagaagaagagaaatccttcatagcccttttagcattgagatagcggtcggctggatggtccgggcttgcatctatcttgagggcctgaggcgtcaatcctaacttgtgccgctactggcagtacgcgaaggtccttcggatctttcggaggggacgaatctactctatgtttattcacttcccggaattattcggatgagacactctacgtacgaccgtatcctttgtcactataattagcatatggagaaaagaaaatcagatacaaggggtgtaattcgtcatgcttcatccgtcattgattcaactatctcataacaagtctacaaacagggtctacccatctctctcggcatctcttttttctcgccatcctgcgccaaacccatacacaagcccgctcagaggcagagatatcacgtagatggcacccaccacgcagaaacaccattgtcggcccagaagatccaggaggggcgtgacgcccgccgtggctcccgccccgagtaagcagcgcaccaggttgtttgcggcggtcgctgtggccggctttccgtaatggagatctacaatcagcacgttcatgacattgtagctcgccgtgacgagatatccgatcagaaggagcatggccagcgcctccacgatggggcgttcggccgcgatcacccagccgtagagggcaatcgaggcggccgccagcatcgctgacggcatggcaatctgcagccgtgcgcgctcaatgggaaactgccggagatcctgcttcccgttgcggatcggcagctgtccgacctggcgggcgatgcgttggaagttccagtcgacgagccatccgttggtgaaggccgacaggatggtgcccaacccaatgggaatataggtgagtccgagctggaagtcgttgagatggtaaatctcgttccactgcgtcggcaccgtcgaggtgacggcgtaataggccgcgtatccgattccattgctcagaaggaccaaccccgttggcatttcaaagagcagacgcagcgtgctccaggggttgggcacacggatccgcgacttttggtgtggcttgggaggagcattatcagcttccggcgacagatttagctgttgcttccctcgagtccgtccgaccatacagtcgagcagagagcgattccaccgaggaggtggaatggacccattgcccacgatcgcacggcaggtctcggggaagaacagcatcaaaagcacgaaaaagacggcagccacgagcgccagaaaccagaagatagaccgccatccgagggattgactcaagagaccgcctagggttggccccagcgcgggtcccaggattcccccgagagaggcgatgcccaaatacatcccccgctcggcggacgtcacggtgtcggccgcaacggcgttggatagcgcgacagtggcgctgatgccggtactttgcagggcccgcagcaccagaagagtcacaaaatctcgttgcagagctaagccgatgttggctacgatatagatgccgaagcagaggacatataccggccgtcggccggccgtatccgagagatctcccataaaggcgggggttagcccttgaaaaacctgtagtgttgatcaggaactgtctcgagagccgtgagaaagtatgacaaagcatacgagcttaccatataggccgtgatggttaggttgaccattccgggactgatcttcaactcatcggcaatggagttgatagccgggtagtagatattggatgagagaggcgaaaaggtcgaggccaaggctgccgtgaagacaatgagcttcttctgcactggggaaaacaccgagtaaggcggttgcggcggtgcaagaagagcagtggcttcgtcgacggtgacccgggggatggggatcttggtggatgaagccatgacagagtgcattgaacctgggcaaagcctgagggagccctgtacaatctgatccaagaatattaaatgatcccccatgatcagtgtcaaccaagcggataagaagcggtccgccgcaatttataaatcctccgcggtgcatttcgtgcccgccacaaagctcgactccgtggggactttgaccatggctcaacacgacaacatgatgaaatcggccaattccaagcattttcgacgaaagctgcgatttcctccagccgggaccggcttgtggtcgacagataacagagtccaaccccccgagaagacgatatagattgcgggttctcacttcctcactcacgctcatctcccacgacaacttgaaccacacactctcacacactcagacatcatggtggcgacaaagcttttctccacggctctggtggccgccgccctggtgttaccgggctctgcgctcagcataatccccttccagaagcccatggagaatccgcacctgtgtgatggcaccggcatcgtggaccccgacggcaactgcaacggggacggtgtcattgatgagcctcccgcacgtccaccacgcttcggaaacccaccgccgcacgagggcagggacagggatgggttcaagttcgagaacccctccacccagtgcaagtacatgtcgcagccggacctctgggacaacttcaagtcgctagagaaggacatgagcaagatctttaccatgatccacaaggacgtcgattttaccatcgtcggtcaccatcccggtgctgggcactacaccgacctgctgcacttctacaccaatgccctgcgtcgctacagcgtctgcttctcccagtaccccgagtatttccgcatctatccccaggccatccacggaggctgcaatagcgagtggtccgtccaggagattctcttcctcggccgtaccaaccacggtaagcaaccctgattgagtatccaaagggaaatagagctaacggtggataggcgtcgactttgatgtgatcaacgtatgggtcacccgctggaaggacggccagatggtcgaggtccgcacctacatcgactccatgcgcatgactggcttgctccatgagaacgagctctggtggaactccagcacctacgaggagcatcccaactacatcccgggcccaacgggtttgccagacctcgacgagctgcgcggtctgatgcgcaagccggatggaagcaggtacgacgacatgtagagagtgtcacggagtaaggtcgtgatggatcaacgctgctaaatgatggacgatgtgcaagaattggaaacgaaatattgtagatggatttcgctcgttgctgttgttgctgattgccatgttttgttcgttgatatagttgagtaaccagactgagatggatgagttggggtatatgttggtgtacataggtcaaccgacctccctcatttaatatggcccttgcactaggcctgactgtcctgagaatgctgtctttactttattagatattataaataacattttattatattctaagcttcctaaacattgaaacctcaaatattaaatattctaaagatcctaacttccctaaaatagcctaatcccctaattctaaccccttaatttctaacattgagatatgtggcaagaatccgaaagatctaagacttaaaataacagaatggtattactgttttatacaaagtccggtctagagcacaggccacattaaatgcgggggagattaggccaagaaatcagcgaggtcgcctggtataggttgaaactcgcgtgagctagatttgaccacagccgaattgcaccatagttacatttcgagtatacctctagaacgccatatccaagcccttattttttgtcaaattgcaaaagagtggtatatacatcgaaaaaaagacatgtgcgttgatcacaactggagtcttaaagcttcacttcagaccggggacggacaaagagatccacaaacccagaaatccccagagactcctcctccaccgccgcctccatccgcgagatttcttccgtggaaaacatcagactcagattcctccggaccttttcacggaccgtcgtgaacgtctgcggatgcttgctgtgcccgactgggaagtggaccagaatctcgtcgagcaccgtgccatcgatcaggcgcaccgtcattcccgacgccagactcttcacgtcgagatccagataatcgcgcgtcagttgctcatctggttgaatctggatcttctcgcgcagtgcagtgatggctcggcttgacgaccagacactgtcatcctggtagtcacggacttcgggcatcgcccccttgaggaacgccaggctcacgatgtactgcagacaatgatcccggtccgcggcgttggacagcgggccccgtttgttgatgatcatgtcggccgcggcattggtcctgatctcgatacagtcaatatccttctcgggatgcttcatgcctcgcgcctgcatcgctgcccgatgacggagcgccgcctcgaccgacgacagtgcgtggccctcgacgggcatgaccttgaaaatgatgttctccatcacccaactgccgtatggctgcggcaggtcgaaggtcttatttccgaacgaggtggcatagaatccccaccggggcatcgtcaacggggtcggggagcccggttgtcccgcgcgagtcagcaaggccagatgcgtggccttcatacaggcatcaccggcggcccagcccttgcgcgggatggtattactgccagagcgatagacgcgcaggggatgaccgtccatccagacctgcgagatagccgccatcgtctgcgtctcggacaggccaaggagccatgccacgacggccgtcgaggccagcttgaccagcacgacatggtccagaccgtgtgaatgaaaggcattctggagcagcatgcacccctggatttcataggccttgatcagcgccgtcagcaatgtacgcatcgtcaatgggggcccagtgtgcacgatgcggcagctggcgacggatcgacacagccagtcactgacggccaggatcgccccgagattatctgcccggaccatgtcagcgactgtcctcggcttctttgtttcgaaaagaagaaatggaaagagtatacccgacggatgtccccagtctgcccccgcgatggcatcattatggtccagatatcgcaccgccgtggccatgtcgaacgagcctttcaaggggtccaagacataggaggtcccgggcatgtggaagccatagggagtcaccgtgtcgggaacgatggggccaaagaatcgcctacaatcggcactcagagcgacagtctcgatggcacagcccatggcatccagaagagccacgcgggcggtggtccatgcctgcggggagtggatatcatagtggaagacatagtctttgatatccacaatgacctggtcgtacgcttgcattttgctcactgattctttggtgggcaatggagttcaatggctggatactgcaatgataaggaatgctgtgtcgttacgaacttacgactataggacatgagcagaaaacccccgcgacggacgaagcatcattcaggcacagggcaggcttgaagattaagcatcagtttcacgtgcttgacaactaaggcgagtcatctacatttgatattccgaaagtgtaaagagaagtctttttgcacgggagagatctctgaattggtcactggacagaaagtcaccgcagcagaaacttgccgcaacccagggctcaggatgcggctctaacggcctccacctcacctcgtctgtccaggctgatgggctcattcagatcgattgactatataaccgcggaaactgtgcgcggtccagcattcgtctggaccagcatcttcctaccgggttcactacctccaccaccaccaccgacaccacattcacaatgccggtgagatttctttgtctgcatggctggggcaccaatatccaggttcgtgcgatgaccgaaagtaatccaatggctcgcgcctcgagtgactgaccataatttatctggcagatcttacagtcccaactcggtagacaccgcagccctacaaaagaaaaaacaaaaaaaaaccccctaaccgtgaacaggccccctaatgcgagagctgcagaaagacaacagcgcggaatttcatttcatccagggcgatgtcgaggcagatcccggcccaggtatcgagggcttctacgaagggccctactacagcttctaccaattcccccggactttccccgacagtgatgacgaggaggacgatggcggagatgcgtccatgttcgaggcctatgagatgatctacgacatcatagccgaggagggtccttttgacggcatcctcggcttctctcacggcggcaccttggcctcgggcttcctcatccatcacagtaagacctccccttatacgccgccccccttccgatgcgccgtgtttttcaattcactgccgccgttccgcatggatcccggcgaggagcttgtcgtggatgatgatctggcccggcacctcacgataccgaccctcagcattgcggggacgcgggactttgtctacaagcagtctctgatgctgcaccagttgtgcgatgagaagtcgtcgcagctgatcctgcatggaaagggccacgagatcccgggggatgcggcgacggtggcgcggatggctaaggcatttcgggcactgtgtttgcgggccatgtatttgtagattgttaataaatcgacccattgattcgatgtacagagctgtgaactgagaatctggatgaagcgctagtaatactattgaaatccgtatacaaagataaaaatgtaggatgactgcaggtggtagttaggagccacggacctggttaagaagataccaaattgtaggggtgaatagacctaaccctggctggctagtctaggtcagtactacagtttagacaggggcaaccaggcaaaatacaattaaaataatcaccattattaactattatctacgcaattactaatgacttaactggacttagagactgaggattctacaagatttcaagaaacaaacaaaaagacatcacatacgaacgccaaaatcactagtgctccgtcaaggttttcggtccacagccccgtaacccctcggcatttggaacaaaagtctccgagtaaaccaccccgactgttatgcatcactgttgtcaaacactccgaatgtgcaatcctgccaccggcgactattccccctcgcagcacggtcatataagtctacagaaaatgttccatatctcgatgatcgtgtatatatttcttcccagccaatcgtcactgactccacgaaagtgcccggacgttcctcatgtccgagtgaagaagtcaaagtcacagtcacggatgaacttgcttctcccatctgtgaatggatatcgtccaacatggttgagaatgtctcctctccttcgtcgccacggacttcgagtccgagtggctcctgtacgcccaccagcgccaccagcgtgggatccgacgacaagagtatgcccattgctgtcgtcgggatgagctttcggggccccagggatgccatcagcgtggagagtctctggaggatgatctccgagggccgcgagggatggagtaaaatccccaagtcacgatggaataatgacgccttctaccatccggatcatagtcggcatggaacggtgagggcttccttttctttgaaagctgaacgcgaagcgagatcaaatggaaagttaaattcctaataaaaattacgagtggctaatggaaacgcttagatcaatgttgaaggagggcatttcttggaagaagatctcgctcgcttcgatgctccctttttcaatatgaccaacgcagaagcagccgtgagtattaagagatttctgacatgcaactatcgtggctgaaacccgtcaggcactggatccccaacaacgactgctactcgaaagcaccttcgaggctgtcgaaaatggtgagttgttggtctttgtttcccagaccaaaatgaatccctgacgatcgtagcgggaatacccctggacaagatgcttgggtccaagacctcctgcttcgtgggctccttctgcggcgactacaccgacatgcttgtgcgagaccccgaggccatccccatgtaccaatgcaccaacgccggtcagtcgcgggccatcacggccaaccgggtctcctacttcttcgatctgcgtgggcccagcgtcaccgttgatacggcttgctccgggagtctagttgccctccacctggcctgtcagagcttacgaacgggggatgcgaaaatggccattgtctccggggtcaataccattctgagccatgagtttatgagcactatgagcatgatgcggtaagagtcgtacccctatcgttttgcggatccagtctctcacaatgtcaggttcctgtcccccgatggacgatgttacacgtttgatgagcgggccaatggctacgcccgaggcgaaggagtcggctgtctacttctgaaacccctgtcggatgccctacgggacaatgatacgatccgcgccgtcattcgagggacgggctccaaccaggacggtaaaacgtcgggcatcaccttaccaaacgccaatgcccagcaggaattgatccgcgacgtctacgcggctgcggggctggatcctctggaaaccgagtatgtcgagtgccacggtaccggcactcaggccggcgatcctctcgagaccggcgccgtggccaaggtcttttctcctggccggccggacgatcggccgctgcgcatcggctctatcaagacgaatgtcggccacttggaaggggcgagcggcattgcaggcgtgatcaaagcggtcctgacgctggagaaccaatgtttcctcccaaatcgaaacttcaagagcattaacccgcgcattccgctcaaggagtggaaattgaaggtgcgtgagttgtcgtcgtctgctaccatcgtcgtctgctaccaacaagaaactgacatcgtcagatccaactggagaatgaacgatgggaaacagtaggcccccatcgggtctccgtcaacagtttcgggtacgggggaagcaatgcacacgccgttcttgaagacaccaagggttaccttgaacagagatccctaacaggctccttccgccgcgtacgagcgcttccccatgccgccactgacctcgagccagtctcggacccgggttctggcccagagcgtacccgactttttgtcctgtccagttttgatcaggcgtctggtcagcaacagatcgaccaactgcgggaatacttggagcagaactcctctcgaatagatgatcaatacctggcagatctcgcttacactctcggcgagcgccgctcgccctttctctggaagacggcgatgccggcatcgtccgtgtccagtctcgtcgaagggttgaagactcgcgccaaggtctctcgggccgagaagaagaagccgacgctgggcttcatcttcacgggtcaaggcgctcaatggtgcggcatgggtcgcgagcttctggcagcgtatcccgtctttgcttcgagcgtggacgctatcgccacctatctgaaaagccttggggctcccttcgacgtccgggaggagctcgtccgggatcccaaggactccaagatcaatcaaccgttgtacagccagccgatatgcaccgccgtccagattgccctggtagatctgctcaccttctggggaatccggcctgcctctgtgaccggccactccagcggcgagcttgcgggggcatacacggcaggggccctgagcatggaacacagtatggccgctgcgtattatcgaggcgttgcgtccagtgatcttccccgagaccacacgcaacgaggcgccatgatggcggtgggagccagtaaagacgccatccagccccgattgtcctcgctgacgacgggcaccgccgtggtcgcgtgcgtcaacagcccctccagcgtcaccatctcgggcgatgcatccgctgtggacgagctgcatggtttgctcgagaaggaccaggtgttcgcgcggaagttggccgtcgacgtcgcctatcactcgcaccatatgaaagccgtggccgaccaatatcgcaccgccatggccgccgccggcgtcaccgcggttcagcctgagtccacggagcccgaagtggaattcttctcgtccgtgacgggcgagaaagccagcctcaccgacctgggaatcgaatactgggtcgccaacctgctcagccaggtcaagtttgccgattccgtgcatcgcctgtgcatggagacgtcggcttccggacgggctcgcaagaccaaaaccaaggcaccgaaacgctcaggggccaacaacaaggccaaggtcgacatgctcgtcgagattggcccgcattcaacgctggcagggccaattcgccagatcctcggggccgaccagacgctggagcaggcgtcgatccgctatgccagtgccctgctgcgcaagtcgagtgcggtcgataccacgctgaccctggcgtcgaccttactgatggccgggtatccgatcgacatggctgccatcaatcgaccgtcggatcaccaccgagtgggcgtcctcgtcgatctccctccctatccgtggaaccactcgggatcatactgggcagagccgcggttgagcaaagcctatcgcaaccgcgctcatccccggaacgaccttctgggagtgttggatacgcattccagcccgcgggagccccggtggcgcaattatctccggacgagcgagatcccttggatcaaagaccatatgatccagtcgaacgtggtgtatccggcggccggctacctcaccatggcggtcgaagccatcgggcaacggattggggacaacttcccgggccaccgcatctcgggataccgactacgagatgtcgcgatcgaggcggctttggtgattagcgacgactcggagccggaggtcatgctctccttgcgtccgtctggcgacagtggcctggttccggccgaacggtggcatgaattccacgtcctttcagtgacccccgacaaccggtggacggagcattgtcgcgggctcatctgcgccgaggtcgcggccatggacggggacgaagatgaccgtggcgcagaggcagggttgaccgccgagacagagcgctggatcgaggaagcggagcagctctgccagaaagacgtcgatatcccccggttctacgcagagttgaccggtctgggtctggaatacggggagacctttgccaacatgacgcgagcacgttcggcctcccatgtctgcctcgcggagatcgaagtcgcggacactgcggctgtcatgcctctgggattccagtctccgttcgtggtccatccctccaccctggacagtctcttccatcctctcttcgtcgctctgtcctccgacgagtcactgcaagatcctgccgtgccggtggccatcgaggagatatggatccgccacggcatggccaaggaggccggacacaagttccaggtctgcgcgtcgacccaggagacgggtcgagaccgcattcaggcagctatctcggtggttgatgctcagagggctcgcagcggaccggcgttgacggtccgcggcctgacgtgccagttcctggaccgcgcatcgggagatgtcgagggcgacgagcagcctacacggcttgcatacgagcttcactgggaggcagatgtagacctgctgtcgtcgagcgacctggccacgctgtgtgcggttggccgtccccgtgatgtaggggagaaggtcgctcgatatgtgaagcttctcggacacaagaaccctcatcttgccatcctggaggtcggagccggtcagggagagctgtgtattccggtgtttcgagccctggcaggggaggccaacagcacgccctcgttccagtcatatacactcgccgacaccgagccgggactgtcggagaccattgccacaattgccgaccagtttgacgaacgcgccgatctgattcaatataaggagctcgacatctcgtcggacccgctgcagcagggcttcaacgctcactctttggacctcatccttcttccttcccggggagtgtcggccacgctccgatcgaagatcctcaaacatgcgcaccaattgctcacgcccgaagggagactgattgtggtcgacacgagggacctgcaggaatggtggcaagctcttcgtgagagcaactttactgatccggaagtgattcacgacagtccgagcgagacggaggccgacatctcggtgctggtgtcgaaaccacaaccacaacctcgggatcagaccccatcagaccctccggatgtcctggttatcgccgagaaccaagactccggcgtgtccattgagcatctccagcgtctgctggcggacgctcatgtgccggcgaccgtcacggatttcgctcatgcagacccggagggcaagacgtgcattgttctcagcgagttgacgacctctctgctgagccatcccgaccagcattcgtttgaaacgctcaaaaggatcctcgtcgccgggggtcgcggcgttctctgggtcgttcggggagcaaccggcccagcgcccaccagcagtctggccaccggtctgctgcgcacgattcgctccgagaccgacgatgatcgaccgattgtgagcctggatctggatgcctcccatcccctgtcggcggaatccgcagcgcaatcgatcttctccgcgttccgccaccgattcgtctcccccggagggagtcacgaggtcgaatacgccgaacgcgatgggatcctgcgcatccctcgcgtcgtcgagagttccctcgtcaaccacgagattgtctcgtccttgcggccggcggtggccgaggaccagccattcttccagcccggacgtccgctggaactcaccgtcggcaccccgggacgtctcgacagtctctactatgtcgaccgctcctgcatctcggagctacccagtgactacgtcgagatcgaagtcaaagccatcgggctcgggaacggcgatgtcaagaccgctctgggacatgacgatgccgcaacccgtctcggagcggaatgcagcggtgtggtgactgctctcggggacgccgtttcgggcttcaagatcggagaccgtgtcgctggctttggcgcaggaaccgtcgccactttataccgagaccaggcggcgcggttccagctcatccccgacgacatgagctttgcgcgtgcggccgctctccccgtggcatatatcactgctttcttcgcggtccacgcgctgggccaggtgagccgaggggaccgagtcctcatccaggacgccggcacggccgcgggccaggctctcctggagctctgtgccctcgccgggggggatatcatcgccgtggtggattcgccctcgcaaagagccttcctcgttggcgagtacgacctcccggcgagcagaatcctggtcggtctccgcggacgacgtctagcaaccagcgtcatgacgctgactaggggctgcggagtcgatgccatcttcaatttccgcggaggcgaggagagacgcctgtgctggagctgcgtggcaccatatggccggttcattgacctgggcggcggaccgtccgacctgacggatatgccgcagctcgagatggccagcttcttttccaagaatgcttccttcacggctctggacttccactacctggtcacgcaaaagccacaggcggtgcaccggatctggtccgacgtgatggccctggtgcgagcaaaggccatccggggcccgcccaggcttcaacttcattccgtctccgaggtcgagaccgcgttgaaacagagtcaggacggatgtgatgtcgagaaagtggtgatccgtgccgaacgggatacaatcgtccaggtctgttgccactctgccccttatgatatcctccctcgtgctaatatgttctcttgcaggccattcctcctccgaagggcgacctgctgagggccgacgcgtcatatgtgctagtcggcggcctcggaggcattggacgagcgatggcatcgtggatgattgccaacggagcccgacacttaatctttgtcaaccgcagtggcctcgcccgcaacgaagcccgggagacggtcgagtctctcgagggtcacggtgcccacgtggcggtctattcttgcgatgtcagcgatcgcgaccaagtcgctcagatggttgctcagagctccaaagagatgccgcccattcgaggcgtgattcaggcggccatgattctccgggtatgtctgccttctcgaaattagtaggtcgaggactgactgtagtaggatatgctgtttgagaaaatgagcgtcgacgacttcaacaccgtcctacagcccaaatggcagggcacatggaatcttcatggcctcctaccccgagacatggacttctttatcatgctgtcctccatcagcggggtcatcggcaacgccactcaggctgcctatgccgctggatcgacgttcttgggcgcgttcgcccagtatcgcagctccctgggactaccggccgtgacgctggatctcggcgttatcactggaatcgggtacctgtccgagcacgaggagctgctccagggcatgcagcgacaaggctttgaaggcaccaacgagcagacgctgatggccctcatccgatcagccattgtcagccctcgtcggacggggtcacaagccgagatcgtcaccgggctggggacctggcgagagggcgtctcgctgggcaacttcgaccagcccttgttcgcgcacttccgccgtcaagccctgggactccgagatgccacggcagagggcccgggcaccagcgtccgggagagtctccggggatgcaagaccctcgacgatgcggtggctctggtctgtgcggctctgatcgaccgcctggcctcgagattgaacaccccggtggacaatatcgactcccagcgggcgatgtcggagtacggggtggactcgctggtggcggtggagatgcgcaactggatcggcaaggagatggagagcacgatgcccattctggagctgctggcgaatcaatccatctcgcagttgtcggagaagatagctcagcggtcaaaggtggtggcagtgagtggaagtgaagagtagagtatgaattgcgatttggatggttttttagttcacatcagatgacggcattgtatttatttgaataaccagaatttgatatcattatttcccaggaagtggaagacaaaaggattcaaggatatctacaatttttgcgtcaaaaattgaatgcatcgtttccttggcggttattggcatactatcaaggtcatcccgctccaatccctaaaacccagtttcaatacgccaactctggagctttttttttttttttcttctagatagttaactgtcacatcctgggatttataagaactacataatgatcgttcccctagaacttctttcaatgataaaacagaaggaaaacaaaaaaagaaagaaacaatcggcacaatcatgaatcataacttttcatcccccctcaacaccagacaaatcgagtcggagtcgcacaaggcgcggtactcagcgaggttgtcgtcactctcggcggaggcgccgagggcgtctcttcgttccgagccgtgaaataactcgccgcaataggttcctgcaaccccgcgacgtgcatgaactgggccaggttgaagcccgagcgggtgtcgacgctgatcggccgggtgctcgagaagcattcggggaagcgatatgtcgtgggctgctcaaataaaaggagcacgtaggtatggcgagggccggggaccgggcgcgggccgacataggggacgtcctcatcactcaacctcgccagccggccggtgaagggatcgcggaccttcaggtcgggctgtagccagtgcaccaggggcgttgcggtgccttcgtggttgacttcgacgtcgatcatcacggcgaggtaggactggaacacactgagaccttgccgaccgaataccggggggtcgatggcatctacacgaatcagatattagtggggaaagctctgactggtcggaagaatatatcacattaccatcgggaaggactaattggcccggttgaatgagctgctggtcacgaaatatgacatccaggcccctcggggtctttggccagtatcctggtggcgtctgggcggcgatcaaggggaggcacaccaaggccagaagaagccacaagtctggacgcatgctgcaaatggacgatagcaatagcggacagccagatcattcactgtctccatagtgtgtagtgtgtagataaggttgtggatatatatttggtggtgcagaagtcgccgtggaaagtgaccgattccccgctattatgcggacaataaagtgattcattccgactcttagaaatggttgcgtacataggtaacgtaaaagaaaagaagacaattataattaatgaagaaatggattaaatcagcatcaacgatttactacaatacaaacaggggcccggaagtttgtagctggccggataggaaaagttgcgggtgatatataaagcatgataataggtcttcacgaccggcagctttggttcatactggcacatatcctgtcttttagaatatcatgtagagctcttctgcgccatcaagtatgcagccacactacccgttgctcgaggatactgaatctctccttcaaacccattcgtatgatgtccattcagaaaatccccaagtgtatatctatgttatgagccatgagaggggcaacagccgaaaacctccctcatgatattgctcgaaaccgcaaactgagattgggaagcataacacatgaagcaatatcttcgctttgtactactgtcctcctactatcaataccaatcgcagttatgcaggtagacctgttctctgtagacgaggctgtgtcggagtcagcctggtctgcctgtgtcccgcagcagagtgtacacattaatagcctcgtcatcgcccaaagcatggccagtccaaaaggctaaatagaacagcaacgtcccagttccttatcttcttgaaagtatctagctcactttactgtacattcattctcatggccgggcggcgtaggcgaagccgcgagcatcgcaggcttcctcagccttgcggtgcggggcagacagccgcaggtgcgatcaaactctacaatttttgtaaaatgtaccaggaagtcgactccatgatcgcccagatagtagaagacgctggaagcctccatcgagctgttgcccaggtggaggagttgaccccgaagcttgttgcagcgagtccttcctccgagaaagtactcgtcccaatcaagaaacaaatcgcagagtgcaaggcagatctcagttcctggaataagagaattgattcattggggctatcgagagcgaaagggatttcagcattcaggaagaggttcaaagcaactgtggacaggtcgtttttcgagaatgtcagaagccggctttgcttccatcgggagcaactgactctgctacttacaaccgccgacgcgtatgtgactctattaccttgccgttatttatccatctaactgttggtcaagtaatgttggagttgagagcctcccgatgacaaacaaatccgagatacgttccaacttcgcgtccgggaaccgggattccaagaacctgtctcgcgtcagctcaccacgattgacaaccggataacagatcaatcagctagtttttttcctctactcaacggcagttcgataggttcttcgatggctatttggagcagggaggacaaactatatgccgtcttgaagctattgatacgaggttgcaatgcctgcaagcccggcttgagcagtcgatcaatccccaaagccagaaaacaacttacaacccgaagaagtctagaagacaagcatatgtacgacagatcccacgcaagacacggttgctggagctcgtgggctcgggaagaggtctctatcatgctcacgaaagacagaccgacattgaagaatttcctctgcgcgtgatacagactgggttgttgctcaccgagcaaaaaggaaagattatgtcgacccttctcgctcttgaggattgatgagggaggatctaggggaacggatcctgaatatgaagattgttgttattgctaggagctagctaggtgggtgaggtggaagttatcccttcctccttgggctaagcctatttagggtgtagggggccgattacttgcttcaaggatcaaaggtacagaagcgcaagtttcgaacagaagctttccatggtcagctttgtcagatctcttcggctcttgctctggttactccaaacccaaaattatctggcattcacggaggtaaggttcccaaggagatatgcctcgaatctcctggccaatgagcctttgaactcgttttggatagcctctgcaggagtaaggtacttcttcatcgtcagcaggacaaaatctcggtccggccttctcacatctgggggtctagttcccctagatcactagagagtcttaaatcaatgggtaagacgatccactatatatttgaggctacatcttgccgtggagggctataccttcatcagttgccgctcccactgtcagaagacatctctgtttgttgttctaccctgtattacggcggaccacttcctatgtcttagattgaataaacacttggtacgtctttagctcaaacaaagagaatgctgtatgaaagtcacaatgaccaacaggtcaaccaattcatatgattacgcaataatacatcgccacaagaccctgatcccaaagaagacattgacaagacatgtaaacagatccgagacaaacttcagaacaggaactgctccgccagtatgatgaaaagtggttaagcagttgtcagaaaatatagaaacgagacaaaaaccgagattcagagacggcttcacacgggcctacctcaagaagcaaggatctcatctagcgtccgatgctcatccaatttacgctctgcttcttgctccatcttcaggtggtaaagaccaccaagttcagcccgctcctcttcactcagaagcgccattctatcctcaaccgaggtaaactccccgtaatatctctgatcgatgaattcccagtaaatgtcatcgaacgagaagctcgacctggccgcaaggcaaaaccagaaacttccattgtggatcgactgctccatgtgctcagacagtcgcggcgagtctacaaccgcgctacgggctgcggcttcatcttcgcactctcgcaggacttcgaggaagatcttctgtcggggcatgtactgggtgaagaagtcgttgaacccattctcccagctgtccggatgggccagcaggagccaccagggagagcaatacgtgaactccagcggtgcagcgtagcagtattcccagtcaatgacgcttgtgatatgaaggtctgagtccacaagcacatttgagggacgcaggtcatcacagaacaagctgaatggaccattattatatgcggtcgagaagttacgcgcaatgtttctgaatagacaccgggccacatatttcttcttgcagtccgcctcgtcgtcaacagcgtcattgcgctgggtccgcaggtgttgcagatggtcttcggcgagggctaagaagtattcgtttgcagtggaaaatgggcctttatgcaggtcctgcggagggaaattcgcgtatgtgagcagctcattaatgttgtatgtcaatggtcgcttatagacggaccaggccccgtctgtgttttgggtgggtgctccgatgcgagagaatcgagatcgggacaactccagcagtactctcgccatttcgcggtacgcagttttcagcttggaaatgctaatctccggctccaagacagccactcgggtacggtcgggcaagggcgccgaaaggtagtctccaagcggactcccttcggcgaagttcatcaccatgtaagggccaacagcacagataccacttccaaggaccttgggaagaggaatggaagtatttcgggtaatataccccataatgcataactcgtcgttgactttctctctccgcagagccacctttcccagaatggggagccgcacaatggcatcgggcccttctctgaaagtcatcctgtagcaccgattgtaggccccatctctgtacgcgacagcctcgatcggaatgcctccccgatgcttcgctgccagcatggcagctaggcgctctgtcaagcactgcttcagattcctcgtccacactatgtacatggtatcgacgcgcttgcgagcttcatcgtcgggatacatggctcaaaatgcggtgttatcgataaaaagaggctggacaaccagagctttgtagaagggaggtgaatcggccttagaaccaccccggattgctcctcttctactccgtataatgcgatgtttggacaccagcacgatctgcaggaaaaaggggtccctgactgaaatgaggttagcgccagaaccaggggtgttttggatggagtctgctagattgatcacaacagcagatcctcctaccgagtcaatgaaatatatagatgtcatgcggatttgactatgtctgttattcttgcaagatcagagatcataggacgtgatcaacccggatgttggctagtggcaaaagccataatccgacaatccatcattgtccgacataacattgaataccttatctttcatgaagtgctcttgagcagcttatctgactcatatcctcagtctttattctcctgatagtactgtctggcttgaagtgaaattgcttcttcctttttgaagttgtttctcatccaccactgacctaggcaggcaggcaggcaggtaggtaggtaggcaggtatatagaacctgcagccagatcctcttctgtcagtatagtcttattcaagttaccttaaatccagtaaatccaagtctaagtaccccgtgctctggtctactccgtttccacttccctcctagcgaagcgctgacagaatagcaagcaaatgtcaaaaacaagcggtcaggccgatcgaaactcactcaaaaagatagttaaaacataacttccgctcctcgggaactcggcaaaatttacgctgtactttgctccggttaataatacctacctcagtcatggaatggaatctttggatccgatgcaaggggggggggcttatatttgtggtttattattttagatgtccgttaggtaaatacggtgaggtcgttgagtacgtcgatgactaaaaaagattgggattatggacataacggacttaggaagctatat

SEQ ID NO: 2 - DNA, 3395 bp, Paecilomyces divaricatus
atgggctcgagtaccttcgagcacgatagcacccccgaatatgggaaacgtttcctaccccatatgatcgatgaaagagcggcttcaggccattcacgtccttatgcttatattgccagatctccgcatccccaggacggcttcgaggaagtcagctacgcacgtctggcgaatgcaatcaaccgggcttcctggtgggtagtcaatgaattaacccctttgactggtgagaatggtgtcttcgcgtacatgggtccgaacgacctgcgatatctgatactgtctgttgcggctataaaaaccggcagaaaggtgggttacctccatttactccataggacgaagaacacggctgatggcgtagatgcttcaaccatcaatgaggaatactgttgaagcacagcagttgctattccaacgcatcggatgcaagacaatcgcctacgcagctaccctggagaagagtctacatcctattttcacatccatctccgggctgcagaccaagcaggctcctagtttagaggatttcctttcggaagatgtggttcctcacttcgaatacaagggcagctacgaaaaattgaccgatgaaccgctcatatacttccacacgtctggatcttcaggtctgttgcctctagtttactgagcgcatctcctagttaactatgagaacaggaaatccgaaaccaattggtttcagtctgcgatggcttcttctcttctctgatgctcccaatttaccccctattaatagtcgcccgtcaacagtgaaggagggcctgtaccgccaaaatactttatgtttccttccaccgttccatgtatgtatggggccctggatatcgagtgcatgatccttgtgagctaaactgtaataggccggcggattcggtcttgctgccgcagtggtgtactttgaagccattgctgtttgtcctcatccggaggttgcaccaacagcagaatacatattgtcgctgctagaccaaaatattgccacggccttatcggttccgccttctctacttgacgcactctcgaagacatctgctgggatcgaggctttgtctaagctggaacacgttggctacgtcggaggcccgttgcccgagcacgttgggcaggctcttgcgccaaagctgaagcacctctacagtctaatgggggcaacggagtgtggctggttccataccatacctggcgacagcagcaaatgggcgtatctacgtttcaacccggatattggctatcggttcgatgagatctccgaaggggtcttcgaattggtcatacctaatagtcccgtaaccaggaaagtgcatggtaccccacatatatttccggaactgaacgaatacagaacaagagatctttactccttagtcccgggagaggaagggtggatgcgttaccagggaaggagtgacgatcttatagtcctgtccaacggtgagaagatcaatcctgtacctctggagggtattataaacagccattcagcgatcaagggtgccctcattgtgggggagtatcgattcttgccttctcttctgatagaggtccaggatgatttcagcgctgaaacagaagaggagcgtctggagctgcttgacaagatctggccaaccgtcgaacaagcaaataagatcgccccacgcttctcccgggtaccgaagtccttgatctatcttgggaagaaggatgaacactttcacagagctgggaaggggaccatccagcgtcagcgcaccgtcagcaactttgcgaaggccttagatgaactatacttcgctgcagagcaggggctgcttgtggaaggtctagagttggatgacccctcaaataaggattcgatcagagcgttcaccaggaagctttacgctcaagctctagatgccgaggaaatcaaagacgaagatgacgtctttaatctcggcatagactctcttcaagtcgctatcacggttcagaagattagggcgaccatgagggcacgaccggtagaactggaccatgagcagatcaatggacaactgatttactctaacccaacggcaggtgaccttgcaacggccctcaataagctcgtaaactgtgaaagaggtgtacctctggacggctctctcaatggtgtcaacgaacgttcgactcgtttgcagcagctacttgacaagtacatagcagcaatgcccacgatgctcgatgaggcggaaaaagcgaatacgggccgctcgactgtcattttgacaggttcaactggttctttaggaagctacctcttgacaaccttgttgtcctcgcctgcagtctcgaaggtagtctgtctcaatcgatctagtgacagcgaaaagcgccagagagctattcataacgcacgtggacaagctatatcttgggagaaagaagaccgagagagagtcgaattcttaacagcagatttatcaaaaccagaccttggtctgggggatcagaaatacagtgatctattgtcagaagcatcagcaatcatccactgcagctggaaagtcgatttcaatcacactctcagttctttcgaagcgacccatattgccggggtgataaatctgatcacactcagcgccaaatctgcacaccacgcacctattatgtttgtctcgagtatatccacagtcttcaattggatcgaaacgcacccgaatctccctgtcccggaagccattctcaatgatctagacagctccgagaaactaggctatggagagtcaaaatatataggcgaaagactaatcgaggcttataccgcgtccacgggcattcaaaatgtcgtcctgagagtcggacaaattgcaggcccggtactttcctcttctggattctggaataagcaggaatggttccccagcctggtcgccagctcaaaacacctgggattattgcctgagtcactagggactatgaatacgattgattggataccggttgaccttctggcatcgattatcacccagctgcttcaatccgtccacaacagcccggaatccgaagtgaagtcacctgctgtctataacctcgtcaaccctcgagtgactacatggcccgctcttctccacagcgttcaagaagaccttggtggacaatcaaacgtacgagtcgtcccattgtcagaatgggtggaagcgcttgagagaagtgcttcgcacaatcacgggtatgtgatagcagagaacccagctgttaaactgcttgatttcttcaagctgctagggaagaacggagaggggaacgtgggcgaagcgaaatcgcaatataaggtagctcgcctgctgagggatagtccacaggctagacagctgggcttcgtttctccagaatggatgcggatgtggttgaagcagtggaagttgtga

SEQ ID NO: 3 - protein, 1077 aa, Paecilomyces divaricatus
MGSSTFEHDSTPEYGKRFLPHMIDERAASGHSRPYAYIARSPHPQDGFEEVSYARLANAINRASWWVVNELTPLTGENGVFAYMGPNDLRYLILSVAAIKTGRKMLQPSMRNTVEAQQLLFQRIGCKTIAYAATLEKSLHPIFTSISGLQTKQAPSLEDFLSEDVVPHFEYKGSYEKLTDEPLIYFHTSGSSGNPKPIGFSLRWLLLFSDAPNLPPINSRPSTVKEGLYRQNTLCFLPPFHAGGFGLAAAVVYFEAIAVCPHPEVAPTAEYILSLLDQNIATALSVPPSLLDALSKTSAGIEALSKLEHVGYVGGPLPEHVGQALAPKLKHLYSLMGATECGWFHTIPGDSSKWAYLRFNPDIGYRFDEISEGVFELVIPNSPVTRKVHGTPHIFPELNEYRTRDLYSLVPGEEGWMRYQGRSDDLIVLSNGEKINPVPLEGIINSHSAIKGALIVGEYRFLPSLLIEVQDDFSAETEEERLELLDKIWPTVEQANKIAPRFSRVPKSLIYLGKKDEHFHRAGKGTIQRQRTVSNFAKALDELYFAAEQGLLVEGLELDDPSNKDSIRAFTRKLYAQALDAEEIKDEDDVFNLGIDSLQVAITVQKIRATMRARPVELDHEQINGQLIYSNPTAGDLATALNKLVNCERGVPLDGSLNGVNERSTRLQQLLDKYIAAMPTMLDEAEKANTGRSTVILTGSTGSLGSYLLTTLLSSPAVSKVVCLNRSSDSEKRQRAIHNARGQAISWEKEDRERVEFLTADLSKPDLGLGDQKYSDLLSEASAIIHCSWKVDFNHTLSSFEATHIAGVINLITLSAKSAHHAPIMFVSSISTVFNWIETHPNLPVPEAILNDLDSSEKLGYGESKYIGERLIEAYTASTGIQNVVLRVGQIAGPVLSSSGFWNKQEWFPSLVASSKHLGLLPESLGTMNTIDWIPVDLLASIITQLLQSVHNSPESEVKSPAVYNLVNPRVTTWPALLHSVQEDLGGQSNVRVVPLSEWVEALERSASHNHGYVIAENPAVKLLDFFKLLGKNGEGNVGEAKSQYKVARLLRDSPQARQLGFVSPEWMRMWLKQWKL

SEQ ID NO: 4 - DNA, 1029 bp, Paecilomyces divaricatus
atgggctacctcgagaatctgcccgcagaactgctgttcctgatcgtcgaccagcttgacagatatgacttgatgaacttgcgcgtggtacaccggcgcttcagtttcgtgaacccacgtgtcttcaaggtcatgcgtttctacaacgagcctaccgtccccgtgaaacttcgcaagctgctcaaacgggaggatatgagatccgctctggacgagataatcttttcgacagactctctcttccggggttacaaccggcacgatgcagccctgaggctcaagagggttgcccgtctgctcgcaaatcacgacgatgtcaacatcaaaaccgtacatctcgtcggcgattcaggaggtctgggacttctgcttcgttactttgcagaagcaggtatcaggtcgcttcggtacctctctggcgccataatttttcgccaccatgagatcaacgaggaatggcttcctcacctgatggatgagtctggcgtcttggaagtcttgggaggcttggaacgcctggacctcactctcaataataggtccgggtttatctcgcacccccgcggtttttccccccacgattttcccaacatatacagcatcatggccgccacgccgagcttgactgagctccttctcaagggcattgaaggacaagattttagcgacatgttggggtgttttatgttcttccggcggaggtcggcttttcctccccggctccgaaaagtgactgtggagcgctgccacactccgctcagcttcctcacacggatcatcaaccatccaagcatcgaagatgtcaccctctcttcggtctctctcattttggatcgatctgagggcattgatgcgaggcggtattatatccgtaagtggcaggacttcttggaagctttcagtgatatatactacgacggcgaggagactcgtaagcggttgactgtgggcgagttgtgggaacgtggcaatctggctacgattgacgttaaccatttgcttggagtgactctattggatccaaactaa

SEQ ID NO: 5 - protein, 342 aa, Paecilomyces divaricatus
MGYLENLPAELLFLIVDQLDRYDLMNLRVVHRRFSFVNPRVFKVMRFYNEPTVPVKLRKLLKREDMRSALDEIIFSTDSLFRGYNRHDAALRLKRVARLLANHDDVNIKTVHLVGDSGGLGLLLRYFAEAGIRSLRYLSGAIIFRHHEINEEWLPHLMDESGVLEVLGGLERLDLTLNNRSGFISHPRGFSPHDFPNIYSIMAATPSLTELLLKGIEGQDFSDMLGCFMFFRRRSAFPPRLRKVTVERCHTPLSFLTRIINHPSIEDVTLSSVSLILDRSEGIDARRYYIRKWQDFLEAFSDIYYDGEETRKRLTVGELWERGNLATIDVNHLLGVTLLDPN

SEQ ID NO: 6 - DNA, 732 bp, Paecilomyces divaricatus
atgctgaccaccgtcaagacgcccaatgccgtacagaacatcgagatcctcgcgcgccggtatggggacattcaagccaacgccgccaacatcaacaccccgtgcgattgcatccatggcatggtgcaggtgatggggaagctgccagatcactacccggtctcctttgatacgatcctgagtttgggcgccgatatcaccacccagtgtgcgcacatggtggcctgcgagcactgccggacccactggcatgccatcatcaccctacagtgcgtcctcgatctggggttggccctgtatgagggggccttttccgcctatgcattgggagaaggggatctgaggagcccggagcggttgggcaccgggcggagatcccgctcctcgacgctgtcccttcctcggccacctggctcctcctccgatggagcagacggtctggccagcgcggacgatttccccgggacgatgaacgggcccccggtctgttgcaccagcccgatgacatggggcgatatcgagatccatgaagaagacgcgcaactgctcgccggcatgctcctgcgccggcgattggcggacctgggggccctgatcggcgagctgaaactcatcctggagaatgtgtggcatcggaatcgcccccaacaatccttctcgctgcaggagtgcgaggactctctgatggtgtcgatggaccggctagtgacgttggtcgggcttttgagatga

SEQ ID NO: 7 - protein, 243 aa, Paecilomyces divaricatus
MLTTVKTPNAVQNIEILARRYGDIQANAANINTPCDCIHGMVQVMGKLPDHYPVSFDTILSLGADITTQCAHMVACEHCRTHWHAIITLQCVLDLGLALYEGAFSAYALGEGDLRSPERLGTGRRSRSSTLSLPRPPGSSSDGADGLASADDFPGTMNGPPVCCTSPMTWGDIEIHEEDAQLLAGMLLRRRLADLGALIGELKLILENVWHRNRPQQSFSLQECEDSLMVSMDRLVTLVGLLR

SEQ ID NO: 8 - DNA, 1047 bp, Paecilomyces divaricatus
atgtcgcacaagctttctctgaatgatggcgtcttaatgcccacagtaagtactaccagatcctttttgtcattttgaattgcatggtgcttatggaatactgcttttttagcttgcatttggcgtgggcactgctttcttgaaacgttctggatcggatgccctgcatcgaccgacggtggatgccgtcaaagaagccctccgtgtcggctatcgccacctcgataccgctgagatgtacaatacagagctcgaagtgggtgcggccatccacgaaagcattgcggagggcattgtccagggaagagatgagctgttcatcacgacaaaggtctccagtgacttccttaacatctccaagtcgattgatgtcagcctccaaaaattgaaattagattacgttgacgcgtaagtcattcccccctgcagagaaatagctcctatcgatcctagccttgatctgtctacaggtatctcattcataccccgtactgggcggaatccgacgacgacctgcagaaggcctggaaaggcatggaggaggtcaaggccagtgggaaggcccgaaccattggtgtctcgaatttccagtcgacgcatctccggaccgttttggcaaccgcgcaaacaccaccctcggtgaatcagctcgaattccacccatatctctcggttcgagatggcaacgactatctcttcagcctacgagacaatatgcgggacatcaccatctccgcttatggcgccctggcgccaatcacaaggaatatcccgggcccactcgacgagactttgaaagaagtggccaacaggtatggcgtgggcactgatctggtgtgtctcagatggtgtattgagcagggggttgccacgatcacaaccagtcgccatgaggaccgaatgaaggggtatctcagggtcttcgacttccagatcacaccggacgaggtgatgcagatcggagcttcggcccaggcatgtctgggggacaaagagcagcccctcactcggattgaaaaataccatatggctcagaaacatacctag

SEQ ID NO: 9 - protein, 305 aa, Paecilomyces divaricatus
MSHKLSLNDGVLMPTLAFGVGTAFLKRSGSDALHRPTVDAVKEALRVGYRHLDTAEMYNTELEVGAAIHESIAEGIVQGRDELFITTKVSSDFLNISKSIDVSLQKLKLDYVDAYLIHTPYWAESDDDLQKAWKGMEEVKASGKARTIGVSNFQSTHLRTVLATAQTPPSVNQLEFHPYLSVRDGNDYLFSLRDNMRDITISAYGALAPITRNIPGPLDETLKEVANRYGVGTDLVCLRWCIEQGVATITTSRHEDRMKGYLRVFDFQITPDEVMQIGASAQACLGDKEQPLTRIEKYHMAQKHT

SEQ ID NO: 10 - DNA, 81 bp, Paecilomyces divaricatus
atggtaagaagaaaataatgagaatgtattaagctgattctcttctagatcggctctcgtgctactgatggcacaagttag

SEQ ID NO: 11 - protein, 11 aa, Paecilomyces divaricatus
MIGSRATDGTS

SEQ ID NO: 12 - DNA, 1923 bp, Paecilomyces divaricatus
atgagcagctataaattccccgtcgacctcaagcagttcaagcagctcaagcttgacccaaaaagcccacagctttctgctcagcagaagaacgacctcctgcataacatcaacattttcagagatgcaatcatcgcattcacggccacgggtgccgcccgtggactcgcgggccacactgggggtccgttcgacactgccccagaggtctgcatcttgctcgccttcatgaacgcgaaccccgatggtttcgttgatgccctgtacgacgaagctggccatcgggttgccacgcaatacttgcttgctgcgctggacggaaagattgaccccgaccacctgctgaactaccgcgctgccgattcgaaactcccgggccaccctgagcttggcctgacgccgggcatcaagttcagctcgggtcgtcttggtcacatgtgggccatgtgcaacggtatctccatggcccacaaggataagaacgtcctgctgctgggatcggatggctcccagcaggaaggaaacgacgccgaggccgcgcgcattgccgttgccaaaaacctgaaggtgaagctgttcatcgacaacaacgacgtcacaatcgccggacatccttcgatatacttgaagggctacgagatcgctcgtacgctcgaggggcacggcttgaaggtcatccgcgcccagggtgagaatctggattcgctttacggggcgatgtgtgaaatcatcaactacaacggccctgccgctgttgtggtagaccggaagatggccgcaggcatcgaagaaattgagggagagacccacgctcacgatgtcattccggtcgatatcgctcgcaaataccttaccaagcgtggatacagcaaggagcagcttgctttctacgaccagatcaagcctggatcgaacccgcaccagtaccagggctcaaccaaggagaagggtgcgaaccgtgcgatttttggtgaagccgtgaactccgtgctcgacggcctcagcaaggaagagcgtgtccgtcgggtcatggtcatcgattctgaccttgcgggctctaccggcctgaaggcaattcaatcgaagcaccccgaggtgttcgttgcatccggtgtcatggagcggggcaacttctccgccgctgctggcttcggattcggcagcaacggcgagcgtcagggtgttttctctactttctcggctttcctggagatgtgcgtctcggaaattaccatggcacgcttgaatcgctgcaccgtcctctcccacttctcccacagcggtgttgatgagatggccgacaacacctgccactttggtctgaatctcttctttgcagacaacggcctgatggatgccgagagcacatcgttgtacttccccgccgacggtgagcagatgaaggcggtcgtcaacaaggtcttttgggataagagcatgcgtttcatcttctcaacgcgttccaaggttccttacatcctcaaagaaggtaccgaccagaagctctatggcgacggctacgagtttgtcccgggcaaggaagaagtcatccgcaagggttccgccggctatgttgtctcgtacggtgatatgctctaccgctcgctcgatgccgttgagcgcctgcgcaaggagggccttgatgttggcctcatcaataagcccacactgaatattgtcgatgaggacaccatcaaggtttacggatcgactccgttcgttgtggtcgtcgagtcaattgctcagaagacgggtcttggctcccgcctgggcagtcaccttcttgagcgcaagcttacgcccaagttcaaggcgattggtgccgtgagggagggctctggcggcttgtacgagcagattaatgcccagggtcttggaccaaacgacatcattgcggcagtgaaggaggtcagtgggaaataa

SEQ ID NO: 13 - protein, 640 aa, Paecilomyces divaricatus
MSSYKFPVDLKQFKQLKLDPKSPQLSAQQKNDLLHNINIFRDAIIAFTATGAARGLAGHTGGPFDTAPEVCILLAFMNANPDGFVDALYDEAGHRVATQYLLAALDGKIDPDHLLNYRAADSKLPGHPELGLTPGIKFSSGRLGHMWAMCNGISMAHKDKNVLLLGSDGSQQEGNDAEAARIAVAKNLKVKLFIDNNDVTIAGHPSIYLKGYEIARTLEGHGLKVIRAQGENLDSLYGAMCEIINYNGPAAVVVDRKMAAGIEEIEGETHAHDVIPVDIARKYLTKRGYSKEQLAFYDQIKPGSNPHQYQGSTKEKGANRAIFGEAVNSVLDGLSKEERVRRVMVIDSDLAGSTGLKAIQSKHPEVFVASGVMERGNFSAAAGFGFGSNGERQGVFSTFSAFLEMCVSEITMARLNRCTVLSHFSHSGVDEMADNTCHFGLNLFFADNGLMDAESTSLYFPADGEQMKAVVNKVFWDKSMRFIFSTRSKVPYILKEGTDQKLYGDGYEFVPGKEEVIRKGSAGYVVSYGDMLYRSLDAVERLRKEGLDVGLINKPTLNIVDEDTIKVYGSTPFVVVVESIAQKTGLGSRLGSHLLERKLTPKFKAIGAVREGSGGLYEQINAQGLGPNDIIAAVKEVSGK

SEQ ID NO: 14 - DNA, 1635 bp, Paecilomyces divaricatus
atggatctgctgaaagagctggatgcgccctctctggcgccctcgttgttgggcaccggcgtcgtcctggtcgtcctgtacttcctcaccgtctccatccagaaccgaattcccccgttcgatgcccccgtggtgtctcacgccaaaggattcctcgcggctctgcaggagggcaaagccaaggtgagtgactttctgtcatcgtggctcgatcatgatggatgaatcctgacgagactgcagtaccgcaatcaacccttcatcctcaacacgccccatcatcctacggtcatcctcccccggaaatggtgggaggagctcaagtcgctgcccgagagccacatctcgttcgaagccgaacggctgtatcgctggggcaagggcaatccgatcgccctcgtcgaccatgtcaccatcgagaccaccaagaacgagctgacccgtcacactgcgcgctcctttcccctgctgctggatgagaccgtctacgcggtcgacaagcacatcgggccctgcgtggactggacgcccatcaccgtctatcccacggacctgcagctcatcgccctgctgagcagccgcacctttgtcggcctgccgctcagtcgcaacgagcgctggctggagatcatgatccgctacaccatcctcagtaaggccgccgcgcgggccctgtggccgtatcccttcctgctgcggccgatcctccagcgctttgcgccccagtcgaaagagttggagaagcagcgcaaggaggccagcgccctggtgcgtcccatcctcgagcagcggctggccgacctgaagcgcccggacttcaagccccccaacgacatgatgcagtgggtgctgcataactgtaccccggcggagcgcgaggatatcgacttcctcgtccagcagcagctcacgctgagcatcgtctcgatacacaccaccgctcacaacctgacccactgcatcttcgacctggccgcccatcccgagtgcatcgagccgctgcgccaggagttcctgccgctgctccgggagacgaacggccagatcgacaagcagctcctgaccaagtgcaacaagctggacagcttctgcaaggaatcccagcggttctgcccgccggggcttatcgtcatgtcccgcaagatcatgagcgacatccccatgagcaacggcaccatcctgcccaagggcctcttcgtggccacctccaactacgatgccacgagcgacgagtccgtcctggggaatccggaccagttcgacgccttccggtacgagcggatgcgcctgcagccgcagcagcggaacctgcaccagctcgtgtcgaccaggtgagctcttttttcaacccccatcctattccttcttcgcaatgaatgaccccctactaagagcacatgcagcacgagtgaactctcgtttggttttggcacccacgcctgtcccggccgcttctttgccgcctttgagatcaagatgatcctcatctacttgctgctcaactacgacctcaagttccaggagggggtcccgccaccccggaatgagatcctcgtcaccgccgtcatgccttctttccagggcaaggtgatgatgaagcggcgacgcgaaaagatcggatggcatgtcgactga

SEQ ID NO: 15 - protein, 500 aa, Paecilomyces divaricatus
MDLLKELDAPSLAPSLLGTGVVLVVLYFLTVSIQNRIPPFDAPVVSHAKGFLAALQEGKAKYRNQPFILNTPHHPTVILPRKWWEELKSLPESHISFEAERLYRWGKGNPIALVDHVTIETTKNELTRHTARSFPLLLDETVYAVDKHIGPCVDWTPITVYPTDLQLIALLSSRTFVGLPLSRNERWLEIMIRYTILSKAAARALWPYPFLLRPILQRFAPQSKELEKQRKEASALVRPILEQRLADLKRPDFKPPNDMMQWVLHNCTPAEREDIDFLVQQQLTLSIVSIHTTAHNLTHCIFDLAAHPECIEPLRQEFLPLLRETNGQIDKQLLTKCNKLDSFCKESQRFCPPGLIVMSRKIMSDIPMSNGTILPKGLFVATSNYDATSDESVLGNPDQFDAFRYERMRLQPQQRNLHQLVSTSTSELSFGFGTHACPGRFFAAFEIKMILIYLLLNYDLKFQEGVPPPRNEILVTAVMPSFQGKVMMKRRREKIGWHVD

SEQ ID NO: 16 - DNA, 1509 bp, Paecilomyces divaricatus
atgtcggcagaagcagagaagcagtcctcctctccggccgactccagcctccagaccatccatgatgaccgcgaccaacccccgggcgatgcggaggatccgaccctcatcacctgggatggacccgacgacccagccaaccccaagaactggtcccggcggcgtaaatgggcggcgacgatggtcgtgtccggcttcaacttcatctcgccgctggccagcgccatgatcgccccgtgtttgcccgcgctggctgccgagctggacatcacctcctccgtcgagcagagcatggcgctcagcgtcttcgtcctgggctacgcggtcggcccgctcgtggtcggtcccttgtccgagctgtacgggcgcgtgcccgtgttgcagacgagcaacctggtgtttctgctgttcaacctcgcctgtggcctggcccggaccaagggcgagatgatcgccttccgcttcatcgccggcctggggggctccgcgccccaggccaccggcggcggcgtcctgggggatctctgggccaccgaggagcgtggccgcgcgctggccttctacagcctggcgccgctgctggggccggccgttgggcccatcgcgggcggcttcgtcgcggagaatacgagctggcgctggatcttctacgccaccaccatctccaacggggtcgtcatgctgctgggcttcctcctcctgcaggagacccgggcctccgtcctgctggagcgcaagaagcgccgccgcatccgtgagaccggcagcaaggcgtggcataccgagactgataacccggatcacaccctgcgcaacatcatcctgaccgcgctcaaccggcccttccgcctgctcttcacccagccgatcgtgcaggtgctggccgtgtacctggcctacatctacggcatcgtgtacttggtgctcgccagtttcccggatctctggacctcccccgatcactacggtgagtcggtcggcatcggcggactgaactacatcgccctcgcgtgtgggttcttgctgggcgcctatctgtgtgcgcccacgcaggaccggatctaccgtcggttgaaggatcgcaacggcggcgtgggccggccggaataccgcatcccgctgatgatccccagtgccatcctcgtgcccgtcggtcttttcatctacggctggaccgccgagtaccgaacgttctggatcggcccggacatcggcatcgccctgtatgccgcgggctacatcaccagcttccagtgcgtccaggtctatatcgtcgacacgtacaccaattatgcggcatcggcgctggcctcggtgaccgtgctgcgcagtctctgtgccttcacctttccgctgtttgccccgaagatgtatgatgcgctggggtatggctggggaaactcgatgctggccttcatcgccatggggctcggatggccgggtccgtttgtgttgtggcgctatgggcaggctctgcgagagcgcagtccatatgccgcagagatataa

SEQ ID NO: 17 - protein, 502 aa, Paecilomyces divaricatus
MSAEAEKQSSSPADSSLQTIHDDRDQPPGDAEDPTLITWDGPDDPANPKNWSRRRKWAATMVVSGFNFISPLASAMIAPCLPALAAELDITSSVEQSMALSVFVLGYAVGPLVVGPLSELYGRVPVLQTSNLVFLLFNLACGLARTKGEMIAFRFIAGLGGSAPQATGGGVLGDLWATEERGRALAFYSLAPLLGPAVGPIAGGFVAENTSWRWIFYATTISNGVVMLLGFLLLQETRASVLLERKKRRRIRETGSKAWHTETDNPDHTLRNIILTALNRPFRLLFTQPIVQVLAVYLAYIYGIVYLVLASFPDLWTSPDHYGESVGIGGLNYIALACGFLLGAYLCAPTQDRIYRRLKDRNGGVGRPEYRIPLMIPSAILVPVGLFIYGWTAEYRTFWIGPDIGIALYAAGYITSFQCVQVYIVDTYTNYAASALASVTVLRSLCAFTFPLFAPKMYDALGYGWGNSMLAFIAMGLGWPGPFVLWRYGQALRERSPYAAEI

SEQ ID NO: 18 - DNA, 952 bp, Paecilomyces divaricatus
atgtccggacacaacaaagcctgtctctgcctgcccgtcgcggtggtcgacgactaccaagcgaagggcagatatgaaacggtgctggacacgaagacatgtacgtatatacttaccgatccccatttgcgacacacatctgcgaaatgtcccgcctaacactcttttctgacggaggatgtagacatcactggtccgtccgacgcctctcgcgcccttttgctgatatacgacgcctttggatactcgccccagctcctgcagggcgccgatatcctggcggcgtcgctgaatgccctggtggtggtcccggacttcttcaagggcaaggtggcctccgagtcctggttccccccggacaccgaagaaaagaaggccgtatgtccgacttgaacgctgtatgcgaatctccagctgatttctggtccaggccattggcgactggtttgccacggcgggcaactttgccgtgcatatcgaaccgatgaaggaactcgtccagcagctctcgacgcagtatcccagcgtgagcggcaaatggggcgcgttcggctactgctggggaggcaagatggtcgcgttgacgtcaggtgaagggaccattttcaagacatccggccagacgcacccagggcaagtcccttgaccatttccctttgagatctcaatcgacactaaccatggggggtgttgcagaatgctctcggccgacgatgtctccaagatcaacatcccccatatcatcctggcgtcgaaggacgaagatgccaccgcggtggccgagtgcaagaaggtcctcgagggtcccggcaagacaggcctggtaaagtcgtatccggaccagatccacggctggatggccgcccgtgccaatctgaaggacgagacggtccgcaaggcgtttgaagatgggtacaagaccgccgcggagttttttgagcagcatctttaa

SEQ ID NO: 19 - protein, 234 aa, Paecilomyces divaricatus
MSGHNKACLCLPVAVVDDYQAKGRYETVLDTKTYITGPSDASRALLLIYDAFGYSPQLLQGADILAASLNALVVVPDFFKGKVASESWFPPDTEEKKAAIGDWFATAGNFAVHIEPMKELVQQLSTQYPSVSGKWGAFGYCWGGKMVALTMLSADDVSKINIPHIILASKDEDATAVAECKKVLEGPGKTGLVKSYPDQIHGWMAARANLKDETVRKAFEDGYKTAAEFFEQHL

SEQ ID NO: 20 - DNA, 1599 bp, Paecilomyces divaricatus
atgccctccgccagcgagaccactccccttctcggggaggaccagtgcccaaaatcatcccagggggccatcgtcccagacttcaagccaccccaagatgagctgaaagcacatagcattttcacacggccacaaaagatcctgatcgtcatcatcgcctccctggctgccttcttctccccggtttcgtcggccatttacttcccggcgctgggcaccttggccgatgccctcggagtgtctgtctcgttgatcaacctcaccgtgaccacgtatctggtaacgtaggaccctacatgatccctctattgttctcccgctgaccgacttccccaggtcatgcaagggctggcgccctccttcattgggagctggtccgatcgagcggggcgacggccgctctacatcgcgtgcttcgtcatctacattggatccaacattggactggccctccagaccaactacgtggctttactgatcctgcgaatggtccagagcgcgggcagcagtccgttggtgtccctggcccaggcagtcgttgcggacatggcgacctccgccgaacgaggccgttatatcagctatgtcacctccggggccatcctgggcccggctgtgggaccgttgatcggaggcatgctgatccagtcgtttggctggcggtcggtcttttggttcctggccatcttcgcgggcgtcgtctttctcctcatgctcgcctgcctgcccgagacctgtcgcgccgtcgtgggagatggctcgattccccctcccacctggatccatatgtcctggctggcatatcgacaccgacgacaaatacccctaaacggccccccgatgaccatctccacgagtccagcagccattcgacccggacgcaaggccagcccgaccggatccctccgcgtgatcgccgaccgggaaaccagcctgatcctgatctacgccggctgcgtgctggccgggtaccaaatggtgtccgcgaatctgtcggaggcactctcggcgcagtacgccttcaacaccttccaggtgggcttgtgcttcctgcccttcggcgccggggctttcctggcgaccctcacgaccggccacatcgtcgactggaacttccggcgcttggcgcgcatccaccacctggacctccgccagggccgccagcaggatctgtcccagttcccgatcgaaaaggcgcggctgcaggtcggcatgccgattgtcggggtcggcgccctgtcggtgctggtgtacggctggacgatgcaagcgcgcacccctctggccgtgccgctggtggcgctgttcgtggtgggctggacggtcagcagctcgaccaactcgatctcggtcctcatcgtcgatctgcatctggacacgccggcgaccgcgacggcggcgaataatctggtgcggtgctggatgggggcgctggcggtggccgtgatggggccggccgtcgaggcgatcgggatcggatggatggggacggtgatatgcgccgtctatatcggcctgttgcccatgctgatgctggtgtggaggaaagggccgacatggcggagggagaagagagaaaaatggccgatgatgacttga

SEQ ID NO: 21 - protein, 513 aa, Paecilomyces divaricatus
MPSASETTPLLGEDQCPKSSQGAIVPDFKPPQDELKAHSIFTRPQKILIVIIASLAAFFSPVSSAIYFPALGTLADALGVSVSLINLTVTTYLVMQGLAPSFIGSWSDRAGRRPLYIACFVIYIGSNIGLALQTNYVALLILRMVQSAGSSPLVSLAQAVVADMATSAERGRYISYVTSGAILGPAVGPLIGGMLIQSFGWRSVFWFLAIFAGVVFLLMLACLPETCRAVVGDGSIPPPTWIHMSWLAYRHRRQIPLNGPPMTISTSPAAIRPGRKASPTGSLRVIADRETSLILIYAGCVLAGYQMVSANLSEALSAQYAFNTFQVGLCFLPFGAGAFLATLTTGHIVDWNFRRLARIHHLDLRQGRQQDLSQFPIEKARLQVGMPIVGVGALSVLVYGWTMQARTPLAVPLVALFVVGWTVSSSTNSISVLIVDLHLDTPATATAANNLVRCWMGALAVAVMGPAVEAIGIGWMGTVICAVYIGLLPMLMLVWRKGPTWRREKREKWPMMT

SEQ ID NO: 22 - DNA, 2240 bp, Paecilomyces divaricatus
atgaacctcgtcagtctctttctcaccgtcgccttcatcccctctgcattggcccagtcgtactatccacccgtaccggccggcaccaccgtggtcaactcgacccagtatcccaatgcgagcattgagtacaaagaggtgagatttccatgccttctggatctcgtaggtacttaaagttggtgtctatagaccacgatctgcgagaccacccccggagtcaaggggtacagcggatatgtccggctccccagcgatgttgtgaacagcgtgaatggaccgcacacgtccaattacttcttctggttcttcgaggcgcgtcacgatccggacaaggctcccctggccatctatctcgacggcggaccggggttgagctcgctgcagggggctttcaccgagacgggaccctgctatgtcaacgaggactccaacagcacccgactcaatccgtggtcgtggaataaccatgtcaacatgctctacattgaccagcccctgtccacgggcttttcctatgatattctggtgaatggcacgttcgactcgctacgcgacaaacagccggccaccgagcactcgatcaaccctctggctgacgaggacgagcctgtggccaacaacacctattttgttgggaccttctcggggcagaaccccggtgagacggccaactctaccgccaacggcgcggtgggcatttggacctttttgcaaacttggctctccgagtacgcctgtcttcgagggtaactttcgcaacgacagctgacgtatgggatcagatttccggaatatcggacgaaggatgatcgaatcagtctatggggtgaagcggtgagtgactgatttggaagtctaattgcagaccagtgcggcgtctctgacggttatgcatataaacatgaagtttgccgggcaattcgctaccatctacgccgagtactttgaagtccaaaatgagcggattcgaaatggcagccttcgacgcgattccaactcgcccgagagtccccggatcatccccgtggacaccgtcgggctcatcaacggttggatagacatgtttcgccaggccgccggctacctaaccctccccttcaacaacacctacggactgcaggtggccaatgcgagcgttcagcgtcagatcacggacgcgtactaccggccgggcggatgcgtggaccagacgcagaaatgccagacggccgccgcagagtcagatccgaagaatcgcgcgcacaacgcgacggtcaatgagctctgcttccagtccgcctacctctgcacgaccaccgtccgaggtcccattgcggcgacacaggtatgttgcgaggagcaagaggtcacggcacagaactgactggggagcagtacaatacgttcgacatgggccattggaaccccgatccatttcccccgagctattacattggctatctcaaccaacgctgggtccaggaggctctgggagtccccctcaactttaccgcacactcatcgttggtcaccatgtgtatgtgtctccccagcggttatcgaaagctctacacaaggctcacaggccagtagcattcctcaaaagcggcgcgtttgccctcccctgggcgcttcaggatctgggaaagcttctcgatcgcggggtgcaggtgacgatgatgtacggtgatcgtgatatggacgtgagctgtaagtattccctttctttgtgcaatgaattggtaattgatgggagtcaatagggatcggtggtgaggaagtcagcctggccatcgatcattcctcggccgcggaattcgccgccagtggatatgagagtatctccgtcaatgcaggctatatcggcggcgtaacacggcaatatgggcgactgtccttttcccgcgtctttgaagcagcgaatagaggtattcattcccaccgtgctatctcatactgttcactatgctgatggcgatggcggccaaatcgcagtgccctcgtaccaaccggaaaccgcctatcaaatcttcatgcgcgccatctttgggaaggacatcgccaccgggtcgacagtcgtcgatgcccgctatgcctcgaccgggccatcatccagcgggcatatccgcaacggactgcccgtggccccgccccccgagtgctatatctgggccccggcgacatgcacgccggcgcagctgaagtcactcggggacgggtcggcggtcgtccgtgattatattgtggtcgagtggtga

SEQ ID NO: 23 - protein, 596 aa, Paecilomyces divaricatus
MNLVSLFLTVAFIPSALAQSYYPPVPAGTTVVNSTQYPNASIEYKETTICETTPGVKGYSGYVRLPSDVVNSVNGPHTSNYFFWFFEARHDPDKAPLAIYLDGGPGLSSLQGAFTETGPCYVNEDSNSTRLNPWSWNNHVNMLYIDQPLSTGFSYDILVNGTFDSLRDKQPATEHSINPLADEDEPVANNTYFVGTFSGQNPGETANSTANGAVGIWTFLQTWLSEYACLRGFPEYRTKDDRISLWGEATSAASLTVMHINMKFAGQFATIYAEYFEVQNERIRNGSLRRDSNSPESPRIIPVDTVGLINGWIDMFRQAAGYLTLPFNNTYGLQVANASVQRQITDAYYRPGGCVDQTQKCQTAAAESDPKNRAHNATVNELCFQSAYLCTTTVRGPIAATQRLSKALHKAHRPVAFLKSGAFALPWALQDLGKLLDRGVQVTMMYGDRDMDVSWIGGEEVSLAIDHSSAAEFAASGYESISVNAGYIGGVTRQYGRLSFSRVFEAANRVPSYQPETAYQIFMRAIFGKDIATGSTVVDARYASTGPSSSGHIRNGLPVAPPPECYIWAPATCTPAQLKSLGDGSAVVRDYIVVEW

SEQ ID NO: 24 - DNA, 1473 bp, Paecilomyces divaricatus
atgccatcctcatccttcccacatccgcccagccctggcgaaacggcaagcaagcccggcgagccggtgaaactgcgctccacgtgtgacgcctgccagaaggccaaacatcggtgctcgcgcgaacagccgtgccaacactgcaagtacaacaaagttccctgcgtgtacagtgccctgcgacgcattggacgtccgccgcggcggaaaccccccggcgacgcggccgagagagagaagacccccaagaggagcaaaaaccgtgccttccagggcaacaacacggcgtccacacacgcctccgaaggcagtcccgccgagcctccattgcccccgacgacggcatccatctccatcagccaccgtgcggtcgattccttctcgtcttcctcctcatacgatcatgcctttctgctcgggcacggcccggccgccgccgccaggatggatgacgacgcctggctggagatggatggctcgaatcatgaccccgcgggggacccctcgggaccccccgcattcgatctggagtctatcctggacttcgacgggccgacgctgagcggaatgaccgccggtgcgtccatggcccccagtgaccagggcccctgtccgcccggcaccgagcccccatccttccttgaatcgttcaaatcggcggcggctccgatgggggatgccttcctgttcctcgagaaccctccgcccttcgagtcgtcggcgggccccggactgcctccgccggccccggaggagccaggggtcggctacccgatgtccatgccggcggacagccatcccgaggggtcggcgccgaggccgcagcgtctcccatcggcgccgccggcccggcactgcgaatgctatcagtcggtgctggccagcctgggggatttcgatcgccgcacctcgctgggactggcgtgctcgatcgacatgctcgtggccctggagcagagcgcccaccggcaggcggcgcaggtcctgcagtgccagggatgttccggcagtcgcccggacctcctcctgctggtggcgctgaagatcgacaacaccgtgggcatgctggagagcgtgtccaagttcaatctgacgctcatccgcccgggcgccgcctcctcgctcctggctggttcccggcggtcgtcgtgtggcgcgtgcgacagcgccagcgtcagcagcggcggcagcagtcaggggtctcgggcgtcgaacaacagtctgtcggggctcatgaacagccggcggctgttggcgggcgcgttcgagatccaagccgaagagaagatccatttcttcaagcagtttctctgcaagcgcctgcgccggctctcctcggtcttgcagcagctgcagcagcgcatgctccaggcgccgcagacgtccatctcacagacggggttcaatctggtgtcggagaatcgtcgacgcctgcagtcggtcatcggccggctggagctgtggcaagggtaa

SEQ ID NO: 25 - protein, 490 aa, Paecilomyces divaricatus
MPSSSFPHPPSPGETASKPGEPVKLRSTCDACQKAKHRCSREQPCQHCKYNKVPCVYSALRRIGRPPRRKPPGDAAEREKTPKRSKNRAFQGNNTASTHASEGSPAEPPLPPTTASISISHRAVDSFSSSSSYDHAFLLGHGPAAAARMDDDAWLEMDGSNHDPAGDPSGPPAFDLESILDFDGPTLSGMTAGASMAPSDQGPCPPGTEPPSFLESFKSAAAPMGDAFLFLENPPPFESSAGPGLPPPAPEEPGVGYPMSMPADSHPEGSAPRPQRLPSAPPARHCECYQSVLASLGDFDRRTSLGLACSIDMLVALEQSAHRQAAQVLQCQGCSGSRPDLLLLVALKIDNTVGMLESVSKFNLTLIRPGAASSLLAGSRRSSCGACDSASVSSGGSSQGSRASNNSLSGLMNSRRLLAGAFEIQAEEKIHFFKQFLCKRLRRLSSVLQQLQQRMLQAPQTSISQTGFNLVSENRRRLQSVIGRLELWQG

SEQ ID NO: 26 - DNA, 1131 bp, Paecilomyces divaricatus
atgcatttcaatcttctcctcgtcttgaccgtcctcctccgccaggctacggcactcgtcctgccgccgtccaacagcacctccaattcgaccggcaaattctccgcccgcaccgtcttccagttcccccagggatactggctggagaatctggccgtccggggcaatggccaggtcctcgcaaccacctacatgccgtcggccggcctgtatctcatcgaccccactcccaatgccagctatcccgcggtcctcgtccaccagttcgagaactcgacctcggccctgggcatcgtggaggcggaggggacagagcccgacaccttctatctggcgacgctgaacttctccgccgcggacggcttcgtcccccgcaccagccaggtctggcgagtggacatgtcctcgttccactactcaccccagaccgggcaggtctccgggaaggcggccgtctcgcatgttacgacgctgtcgtcggtgggcatggccaacggtatgaccctgctggctccggactcgtcgcacatcctgatcgcggactcccttcggggcgccatctgggacctggacaccgcgacgggccactatggcctctcgtcgtccttccccgccatgcggtccgacaatccggcgcgccgcttcctcgggatcgacggagtcaaggtgcaccagggcagcctgtatttcaacaatgcgggtgaattcaccctcgcccgcatgcccatccacagcgatggcatcgccaagggggagccggtcgtcctggccacggacctctacagcgatgggttctgtctgtacgacgccgacacggtgctggtgacgatgaacatcgacaacggcctcgccgcgctggacctggagagccatcgccggtggatggtggccggcaacatgcccgacggggtctttacgactccaacgtcggtcgagctgggccgcggggaggacgcgggcaaactcgcctacgtgaccatgggaggcacctacgtggcgaccggtgccgaggatctcgtcgggggcagcttagtcgtggtggacctgaagtcggccacgaccgatccgaaaggaacgggaagaggtgggctgctggtgcaggagacagagacgatttggttggagctgtag

SEQ ID NO: 27 - protein, 376 aa, Paecilomyces divaricatus
MHFNLLLVLTVLLRQATALVLPPSNSTSNSTGKFSARTVFQFPQGYWLENLAVRGNGQVLATTYMPSAGLYLIDPTPNASYPAVLVHQFENSTSALGIVEAEGTEPDTFYLATLNFSAADGFVPRTSQVWRVDMSSFHYSPQTGQVSGKAAVSHVTTLSSVGMANGMTLLAPDSSHILIADSLRGAIWDLDTATGHYGLSSSFPAMRSDNPARRFLGIDGVKVHQGSLYFNNAGEFTLARMPIHSDGIAKGEPVVLATDLYSDGFCLYDADTVLVTMNIDNGLAALDLESHRRWMVAGNMPDGVFTTPTSVELGRGEDAGKLAYVTMGGTYVATGAEDLVGGSLVVVDLKSATTDPKGTGRGGLLVQETETIWLEL

SEQ ID NO: 28 - DNA, 1598 bp, Paecilomyces divaricatus
atgtcgcatggagctctacatatccgagactcccgcacatcgcgggagtatgagatccccatccggcgcaacaccgtcctcgccaccgatctcaagcagatcaaggcgtccccggtgggcgcggatcgagcggacaaagtgggcgatggcctgcgggtctttgatccgggtctcaagaacacctgcgtggtggagaccaacatgacatatacgtagggaacgggtccaagagagttcccccccgggggaaggttctttatttcactaatgctcaatttagggacggacatcgcgggctgttgctttttcggggctatgccctggagcaactatggcaggccgagttcgaggacatgctgcatctcttggtctggggcaaatatcccacgccgtctcagcgagaggcgttgcgtctgaccttggccacgctcatgtcgaccacgcccaaacatgtcgcggaggtgattgagacattcccgtaggtcttctactgtgcttttcatcgtccatcacgatcaccttgaatgaatgaagaactgaaccccctgcagtccgacaagccccccgatgcccatgattgtggccgggctgtccgcgtatctggcccaccatgccgactccatcccagcctgtgccgggggcaacatctaccatggaaatcccgaacagactgaccgtgccattctccggacggcagccgcctacgcggtggtgatgggcatggcggccagccaccgtcgcggcatcgccttcacgccggccacgacggataacacctactttgagaacctgttcatcatgatgggcctggttgaaccgtacaccggtcgtccagacccggtgaagctgtcctgcttccggcggtttgcggcgctcaactccgagcacggcatggcgctgtcctcgtttgcgatggtggtaaccgcctcctcgctgacggatcccatctcgggcctcatcagctccctggtggctgcgtacgggcccctgcactttggcgccccggaggcggaatacaaaaccatccaagcggtcggcagcgtcgaccaggtgccggcttttctggaggaggtcaagtctggcaagcggcggctgtttgggtacggccatcgcacgtacacgacgatcgacccccgggtgaagcccatcaaagatatgctcttcagcgagctggacggggactcggatccgctggtcaaggtggcgcgggagatcgatcgcctctcgtcgaccgatgagtatttcatcaaacgaaaactgcatgcgaacgcggacttttacggaacctttttctttaatcgcctgtaagttgtttttctgttgattgcagtggatgacaattgaccggtcgggtcgtaggggattccaaccggaggaaatcccggttgcaatggtagcacagcggttggtgggcatcctggcgcattatcgggagtccatgtgtaggtccagccgatttccaactttcaagcaagggcaagagagctgataaaatgcccgcagtgaaaaacaaaatccgcctcttccggcccacgcacgtctacacgggggagaccgaaccagtgctcgagatgacggcgccgtcggcgaagctatga

SEQ ID NO: 29 - protein, 446 aa, Paecilomyces divaricatus
MSHGALHIRDSRTSREYEIPIRRNTVLATDLKQIKASPVGADRADKVGDGLRVFDPGLKNTCVVETNMTYTDGHRGLLLFRGYALEQLWQAEFEDMLHLLVWGKYPTPSQREALRLTLATLMSTTPKHVAEVIETFPPTSPPMPMIVAGLSAYLAHHADSIPACAGGNIYHGNPEQTDRAILRTAAAYAVVMGMAASHRRGIAFTPATTDNTYFENLFIMMGLVEPYTGRPDPVKLSCFRRFAALNSEHGMALSSFAMVVTASSLTDPISGLISSLVAAYGPLHFGAPEAEYKTIQAVGSVDQVPAFLEEVKSGKRRLFGYGHRTYTTIDPRVKPIKDMLFSELDGDSDPLVKVAREIDRLSSTDEYFIKRKLHANADFYGTFFFNRLGFQPEEIPVAMVAQRLVGILAHYRESMLKNKIRLFRPTHVYTGETEPVLEMTAPSAKL

SEQ ID NO: 30 - DNA, 1094 bp, Paecilomyces divaricatus
atggcctccaaggaaactttcagcaaataccctgccttccccgacaacatccccacggcggcggtccccaagatctccctccgccagattttgtcccgcgaccccaccgtgtcgaagcgtctggtcgacgcgggcaaggaattcggctgcttcaaggtcgacctgaccgatgccatcgacggccctgtcctctgtcagggcgtcgagcgcggctttgacctgggcaaggccttcttcgaccaagacatcgagaccaagaaggcatacaagctgagtcacgagaacgtcgggtaggtttctccccagccgacgtcggcccagatgatactcacccacgggtgcacaggtacaagcaggccggcgttctggtcattaccaaggagcggcgagaccaggtcgagacatgctccgtctcgcgcgatgatctggcggccagccgacccgacctgccctctgtgttcgaccagcagcggctgctgctccagggcctcgttgcgcagctcgggcagctctcgcacctggccgtctaccatctgtcggagggtctggggctggattatggagtcgtgtcggcgcgccatgatccccgcgaccagtccgccacgatgatccgtttcctgcataatccgccgcagagaggaccgcgcgaggagctgccctcgaccgaggacccgggttcgcgggcctacctgatgggccacagcgacgggggcacggtgaccatcctgttcaacgtcctgggtggactgcagctccagcgccagcagcccgatggctccatcgagtggcagtacattccgcccgagcccggctgtgccttgatcatggtgggcgacgccttcaagtccttcacggacggggaagtcccctcgtgcgtgcaccgggtcatccagccgccgggcgagcaggatcgcttcgatcggtatgcgctgggcttcttcctcaagcccgccaacggggcctccattggaccagtgccgcgccggggcgtgacggagaatggcgtcaacaaggcgtcggactatggagagtgggcaaagaacaagaacgcggcgttgtacaacgagatgcgccaggagaatgtggcaatttag

SEQ ID NO: 31 - protein, 345 aa, Paecilomyces divaricatus
MASKETFSKYPAFPDNIPTAAVPKISLRQILSRDPTVSKRLVDAGKEFGCFKVDLTDAIDGPVLCQGVERGFDLGKAFFDQDIETKKAYKLSHENVGYKQAGVLVITKERRDQVETCSVSRDDLAASRPDLPSVFDQQRLLLQGLVAQLGQLSHLAVYHLSEGLGLDYGVVSARHDPRDQSATMIRFLHNPPQRGPREELPSTEDPGSRAYLMGHSDGGTVTILFNVLGGLQLQRQQPDGSIEWQYIPPEPGCALIMVGDAFKSFTDGEVPSCVHRVIQPPGEQDRFDRYALGFFLKPANGASIGPVPRRGVTENGVNKASDYGEWAKNKNAALYNEMRQENVAI

SEQ ID NO: 32 - DNA, 1661 bp, Paecilomyces divaricatus
atgggggatcatttaatattcttggatcagattgtacagggctccctcaggctttgcccaggttcaatgcactctgtcatggcttcatccaccaagatccccatcccccgggtcaccgtcgacgaagccactgctcttcttgcaccgccgcaaccgccttactcggtgttttccccagtgcagaagaagctcattgtcttcacggcagccttggcctcgaccttttcgcctctctcatccaatatctactacccggctatcaactccattgccgatgagttgaagatcagtcccggaatggtcaacctaaccatcacggcctatatggtaagctcgtatgctttgtcatactttctcacggctctcgagacagttcctgatcaacactacaggtttttcaagggctaacccccgcctttatgggagatctctcggatacggccggccgacggccggtatatgtcctctgcttcggcatctatatcgtagccaacatcggcttagctctgcaacgagattttgtgactcttctggtgctgcgggccctgcaaagtaccggcatcagcgccactgtcgcgctatccaacgccgttgcggccgacaccgtgacgtccgccgagcgggggatgtatttgggcatcgcctctctcgggggaatcctgggacccgcgctggggccaaccctaggcggtctcttgagtcaatccctcggatggcggtctatcttctggtttctggcgctcgtggctgccgtctttttcgtgcttttgatgctgttcttccccgagacctgccgtgcgatcgtgggcaatgggtccattccacctcctcggtggaatcgctctctgctcgactgtatggtcggacggactcgagggaagcaacagctaaatctgtcgccggaagctgataatgctcctcccaagccacaccaaaagtcgcggatccgtgtgcccaacccctggagcacgctgcgtctgctctttgaaatgccaacggggttggtccttctgagcaatggaatcggatacgcggcctattacgccgtcacctcgacggtgccgacgcagtggaacgagatttaccatctcaacgacttccagctcggactcacctatattcccattgggttgggcaccatcctgtcggccttcaccaacggatggctcgtcgactggaacttccaacgcatcgcccgccaggtcggacagctgccgatccgcaacgggaagcaggatctccggcagtttcccattgagcgcgcacggctgcagattgccatgccgtcagcgatgctggcggccgcctcgattgccctctacggctgggtgatcgcggccgaacgccccatcgtggaggcgctggccatgctccttctgatcggatatctcgtcacggcgagctacaatgtcatgaacgtgctgattgtagatctccattacggaaagccggccacagcgaccgccgcaaacaacctggtgcgctgcttactcggggcgggagccacggcgggcgtcacgcccctcctggatcttctgggccgacaatggtgtttctgcgtggtgggtgccatctacgtgatatctctgcctctgagcgggcttgtgtatgggtttggcgcaggatggcgagaaaaaagagatgccgagagagatgggtag

SEQ ID NO: 33 - protein, 531 aa, Paecilomyces divaricatus
MGDHLIFLDQIVQGSLRLCPGSMHSVMASSTKIPIPRVTVDEATALLAPPQPPYSVFSPVQKKLIVFTAALASTFSPLSSNIYYPAINSIADELKISPGMVNLTITAYMVFQGLTPAFMGDLSDTAGRRPVYVLCFGIYIVANIGLALQRDFVTLLVLRALQSTGISATVALSNAVAADTVTSAERGMYLGIASLGGILGPALGPTLGGLLSQSLGWRSIFWFLALVAAVFFVLLMLFFPETCRAIVGNGSIPPPRWNRSLLDCMVGRTRGKQQLNLSPEADNAPPKPHQKSRIRVPNPWSTLRLLFEMPTGLVLLSNGIGYAAYYAVTSTVPTQWNEIYHLNDFQLGLTYIPIGLGTILSAFTNGWLVDWNFQRIARQVGQLPIRNGKQDLRQFPIERARLQIAMPSAMLAAASIALYGWVIAAERPIVEALAMLLLIGYLVTASYNVMNVLIVDLHYGKPATATAANNLVRCLLGAGATAGVTPLLDLLGRQWCFCVVGAIYVISLPLSGLVYGFGAGWREKRDAERDG

SEQ ID NO: 34 - DNA, 1087 bp, Paecilomyces divaricatus
atggtggcgacaaagcttttctccacggctctggtggccgccgccctggtgttaccgggctctgcgctcagcataatccccttccagaagcccatggagaatccgcacctgtgtgatggcaccggcatcgtggaccccgacggcaactgcaacggggacggtgtcattgatgagcctcccgcacgtccaccacgcttcggaaacccaccgccgcacgagggcagggacagggatgggttcaagttcgagaacccctccacccagtgcaagtacatgtcgcagccggacctctgggacaacttcaagtcgctagagaaggacatgagcaagatctttaccatgatccacaaggacgtcgattttaccatcgtcggtcaccatcccggtgctgggcactacaccgacctgctgcacttctacaccaatgccctgcgtcgctacagcgtctgcttctcccagtaccccgagtatttccgcatctatccccaggccatccacggaggctgcaatagcgagtggtccgtccaggagattctcttcctcggccgtaccaaccacggtaagcaaccctgattgagtatccaaagggaaatagagctaacggtggataggcgtcgactttgatgtgatcaacgtatgggtcacccgctggaaggacggccagatggtcgaggtccgcacctacatcgactccatgcgcatgactggcttgctccatgagaacgagctctggtggaactccagcacctacgaggagcatcccaactacatcccgggcccaacgggtttgccagacctcgacgagctgcgcggtctgatgcgcaagccggatggaagcaggtacgacgacatgtagagagtgtcacggagtaaggtcgtgatggatcaacgctgctaaatgatggacgatgtgcaagaattggaaacgaaatattgtagatggatttcgctcgttgctgttgttgctgattgccatgttttgttcgttgatatagttgagtaaccagactgagatggatgagttggggtatatgttggtgtacataggtcaaccgacctccctcatttaatatggcccttgcactag

SEQ ID NO: 35 - protein, 275 aa, Paecilomyces divaricatus
MVATKLFSTALVAAALVLPGSALSIIPFQKPMENPHLCDGTGIVDPDGNCNGDGVIDEPPARPPRFGNPPPHEGRDRDGFKFENPSTQCKYMSQPDLWDNFKSLEKDMSKIFTMIHKDVDFTIVGHHPGAGHYTDLLHFYTNALRRYSVCFSQYPEYFRIYPQAIHGGCNSEWSVQEILFLGRTNHGVDFDVINVWVTRWKDGQMVEVRTYIDSMRMTGLLHENELWWNSSTYEEHPNYIPGPTGLPDLDELRGLMRKPDGSRSTDLPHLIWPLH

SEQ ID NO: 36 - DNA, 1530 bp, Paecilomyces divaricatus
atgcaagcgtacgaccaggtcattgtggatatcaaagactatgtcttccactatgatatccactccccgcaggcatggaccaccgcccgcgtggctcttctggatgccatgggctgtgccatcgagactgtcgctctgagtgccgattgtaggcgattctttggccccatcgttcccgacacggtgactccctatggcttccacatgcccgggacctcctatgtcttggaccccttgaaaggctcgttcgacatggccacggcggtgcgatatctggaccataatgatgccatcgcgggggcagactggggacatccgtcgggtatactctttccatttcttcttttcgaaacaaagaagccgaggacagtcgctgacatggtccgggcagataatctcggggcgatcctggccgtcagtgactggctgtgtcgatccgtcgccagctgccgcatcgtgcacactgggcccccattgacgatgcgtacattgctgacggcgctgatcaaggcctatgaaatccaggggtgcatgctgctccagaatgcctttcattcacacggtctggaccatgtcgtgctggtcaagctggcctcgacggccgtcgtggcatggctccttggcctgtccgagacgcagacgatggcggctatctcgcaggtctggatggacggtcatcccctgcgcgtctatcgctctggcagtaataccatcccgcgcaagggctgggccgccggtgatgcctgtatgaaggccacgcatctggccttgctgactcgcgcgggacaaccgggctccccgaccccgttgacgatgccccggtggggattctatgccacctcgttcggaaataagaccttcgacctgccgcagccatacggcagttgggtgatggagaacatcattttcaaggtcatgcccgtcgagggccacgcactgtcgtcggtcgaggcggcgctccgtcatcgggcagcgatgcaggcgcgaggcatgaagcatcccgagaaggatattgactgtatcgagatcaggaccaatgccgcggccgacatgatcatcaacaaacggggcccgctgtccaacgccgcggaccgggatcattgtctgcagtacatcgtgagcctggcgttcctcaagggggcgatgcccgaagtccgtgactaccaggatgacagtgtctggtcgtcaagccgagccatcactgcactgcgcgagaagatccagattcaaccagatgagcaactgacgcgcgattatctggatctcgacgtgaagagtctggcgtcgggaatgacggtgcgcctgatcgatggcacggtgctcgacgagattctggtccacttcccagtcgggcacagcaagcatccgcagacgttcacgacggtccgtgaaaaggtccggaggaatctgagtctgatgttttccacggaagaaatctcgcggatggaggcggcggtggaggaggagtctctggggatttctgggtttgtggatctctttgtccgtccccggtctgaagtgaagctttaa

SEQ ID NO: 37 - protein, 509 aa, Paecilomyces divaricatus
MQAYDQVIVDIKDYVFHYDIHSPQAWTTARVALLDAMGCAIETVALSADCRRFFGPIVPDTVTPYGFHMPGTSYVLDPLKGSFDMATAVRYLDHNDAIAGADWGHPSGILFPFLLFETKKPRTVADMVRADNLGAILAVSDWLCRSVASCRIVHTGPPLTMRTLLTALIKAYEIQGCMLLQNAFHSHGLDHVVLVKLASTAVVAWLLGLSETQTMAAISQVWMDGHPLRVYRSGSNTIPRKGWAAGDACMKATHLALLTRAGQPGSPTPLTMPRWGFYATSFGNKTFDLPQPYGSWVMENIIFKVMPVEGHALSSVEAALRHRAAMQARGMKHPEKDIDCIEIRTNAAADMIINKRGPLSNAADRDHCLQYIVSLAFLKGAMPEVRDYQDDSVWSSSRAITALREKIQIQPDEQLTRDYLDLDVKSLASGMTVRLIDGTVLDEILVHFPVGHSKHPQTFTTVREKVRRNLSLMFSTEEISRMEAAVEEESLGISGFVDLFVRPRSEVKL

SEQ ID NO: 38 - DNA, 814 bp, Paecilomyces divaricatus
atgccggtgagatttctttgtctgcatggctggggcaccaatatccaggttcgtgcgatgaccgaaagtaatccaatggctcgcgcctcgagtgactgaccataatttatctggcagatcttacagtcccaactcggtagacaccgcagccctacaaaagaaaaaacaaaaaaaaaccccctaaccgtgaacaggccccctaatgcgagagctgcagaaagacaacagcgcggaatttcatttcatccagggcgatgtcgaggcagatcccggcccaggtatcgagggcttctacgaagggccctactacagcttctaccaattcccccggactttccccgacagtgatgacgaggaggacgatggcggagatgcgtccatgttcgaggcctatgagatgatctacgacatcatagccgaggagggtccttttgacggcatcctcggcttctctcacggcggcaccttggcctcgggcttcctcatccatcacagtaagacctccccttatacgccgccccccttccgatgcgccgtgtttttcaattcactgccgccgttccgcatggatcccggcgaggagcttgtcgtggatgatgatctggcccggcacctcacgataccgaccctcagcattgcggggacgcgggactttgtctacaagcagtctctgatgctgcaccagttgtgcgatgagaagtcgtcgcagctgatcctgcatggaaagggccacgagatcccgggggatgcggcgacggtggcgcggatggctaaggcatttcgggcactgtgtttgcgggccatgtatttgtag

SEQ ID NO: 39 - protein, 200 aa, Paecilomyces divaricatus
MPKDNSAEFHFIQGDVEADPGPGIEGFYEGPYYSFYQFPRTFPDSDDEEDDGGDASMFEAYEMIYDIIAEEGPFDGILGFSHGGTLASGFLIHHSKTSPYTPPPFRCAVFFNSLPPFRMDPGEELVVDDDLARHLTIPTLSIAGTRDFVYKQSLMLHQLCDEKSSQLILHGKGHEIPGDAATVARMAKAFRALCLRAMYL

SEQ ID NO: 40 - DNA, 7783 bp, Paecilomyces divaricatus
atggttgagaatgtctcctctccttcgtcgccacggacttcgagtccgagtggctcctgtacgcccaccagcgccaccagcgtgggatccgacgacaagagtatgcccattgctgtcgtcgggatgagctttcggggccccagggatgccatcagcgtggagagtctctggaggatgatctccgagggccgcgagggatggagtaaaatccccaagtcacgatggaataatgacgccttctaccatccggatcatagtcggcatggaacggtgagggcttccttttctttgaaagctgaacgcgaagcgagatcaaatggaaagttaaattcctaataaaaattacgagtggctaatggaaacgcttagatcaatgttgaaggagggcatttcttggaagaagatctcgctcgcttcgatgctccctttttcaatatgaccaacgcagaagcagccgtgagtattaagagatttctgacatgcaactatcgtggctgaaacccgtcaggcactggatccccaacaacgactgctactcgaaagcaccttcgaggctgtcgaaaatggtgagttgttggtctttgtttcccagaccaaaatgaatccctgacgatcgtagcgggaatacccctggacaagatgcttgggtccaagacctcctgcttcgtgggctccttctgcggcgactacaccgacatgcttgtgcgagaccccgaggccatccccatgtaccaatgcaccaacgccggtcagtcgcgggccatcacggccaaccgggtctcctacttcttcgatctgcgtgggcccagcgtcaccgttgatacggcttgctccgggagtctagttgccctccacctggcctgtcagagcttacgaacgggggatgcgaaaatggccattgtctccggggtcaataccattctgagccatgagtttatgagcactatgagcatgatgcggtaagagtcgtacccctatcgttttgcggatccagtctctcacaatgtcaggttcctgtcccccgatggacgatgttacacgtttgatgagcgggccaatggctacgcccgaggcgaaggagtcggctgtctacttctgaaacccctgtcggatgccctacgggacaatgatacgatccgcgccgtcattcgagggacgggctccaaccaggacggtaaaacgtcgggcatcaccttaccaaacgccaatgcccagcaggaattgatccgcgacgtctacgcggctgcggggctggatcctctggaaaccgagtatgtcgagtgccacggtaccggcactcaggccggcgatcctctcgagaccggcgccgtggccaaggtcttttctcctggccggccggacgatcggccgctgcgcatcggctctatcaagacgaatgtcggccacttggaaggggcgagcggcattgcaggcgtgatcaaagcggtcctgacgctggagaaccaatgtttcctcccaaatcgaaacttcaagagcattaacccgcgcattccgctcaaggagtggaaattgaaggtgcgtgagttgtcgtcgtctgctaccatcgtcgtctgctaccaacaagaaactgacatcgtcagatccaactggagaatgaacgatgggaaacagtaggcccccatcgggtctccgtcaacagtttcgggtacgggggaagcaatgcacacgccgttcttgaagacaccaagggttaccttgaacagagatccctaacaggctccttccgccgcgtacgagcgcttccccatgccgccactgacctcgagccagtctcggacccgggttctggcccagagcgtacccgactttttgtcctgtccagttttgatcaggcgtctggtcagcaacagatcgaccaactgcgggaatacttggagcagaactcctctcgaatagatgatcaatacctggcagatctcgcttacactctcggcgagcgccgctcgccctttctctggaagacggcgatgccggcatcgtccgtgtccagtctcgtcgaagggttgaagactcgcgccaaggtctctcgggccgagaagaagaagccgacgctgggcttcatcttcacgggtcaaggcgctcaatggtgcggcatgggtcgcgagcttctggcagcgtatcccgtctttgcttcgagcgtggacgctatcgccacctatctgaaaagccttggggctcccttcgacgtccgggaggagctcgtccgggatcccaaggactccaagatcaatcaaccgttgtacagccagccgatatgcaccgccgtccagattgccctggtagatctgctcaccttctggggaatccggcctgcctctgtgaccggccactccagcggcgagcttgcgggggcatacacggcaggggccctgagcatggaacacagtatggccgctgcgtattatcgaggcgttgcgtccagtgatcttccccgagaccacacgcaacgaggcgccatgatggcggtgggagccagtaaagacgccatccagccccgattgtcctcgctgacgacgggcaccgccgtggtcgcgtgcgtcaacagcccctccagcgtcaccatctcgggcgatgcatccgctgtggacgagctgcatggtttgctcgagaaggaccaggtgttcgcgcggaagttggccgtcgacgtcgcctatcactcgcaccatatgaaagccgtggccgaccaatatcgcaccgccatggccgccgccggcgtcaccgcggttcagcctgagtccacggagcccgaagtggaattcttctcgtccgtgacgggcgagaaagccagcctcaccgacctgggaatcgaatactgggtcgccaacctgctcagccaggtcaagtttgccgattccgtgcatcgcctgtgcatggagacgtcggcttccggacgggctcgcaagaccaaaaccaaggcaccgaaacgctcaggggccaacaacaaggccaaggtcgacatgctcgtcgagattggcccgcattcaacgctggcagggccaattcgccagatcctcggggccgaccagacgctggagcaggcgtcgatccgctatgccagtgccctgctgcgcaagtcgagtgcggtcgataccacgctgaccctggcgtcgaccttactgatggccgggtatccgatcgacatggctgccatcaatcgaccgtcggatcaccaccgagtgggcgtcctcgtcgatctccctccctatccgtggaaccactcgggatcatactgggcagagccgcggttgagcaaagcctatcgcaaccgcgctcatccccggaacgaccttctgggagtgttggatacgcattccagcccgcgggagccccggtggcgcaattatctccggacgagcgagatcccttggatcaaagaccatatgatccagtcgaacgtggtgtatccggcggccggctacctcaccatggcggtcgaagccatcgggcaacggattggggacaacttcccgggccaccgcatctcgggataccgactacgagatgtcgcgatcgaggcggctttggtgattagcgacgactcggagccggaggtcatgctctccttgcgtccgtctggcgacagtggcctggttccggccgaacggtggcatgaattccacgtcctttcagtgacccccgacaaccggtggacggagcattgtcgcgggctcatctgcgccgaggtcgcggccatggacggggacgaagatgaccgtggcgcagaggcagggttgaccgccgagacagagcgctggatcgaggaagcggagcagctctgccagaaagacgtcgatatcccccggttctacgcagagttgaccggtctgggtctggaatacggggagacctttgccaacatgacgcgagcacgttcggcctcccatgtctgcctcgcggagatcgaagtcgcggacactgcggctgtcatgcctctgggattccagtctccgttcgtggtccatccctccaccctggacagtctcttccatcctctcttcgtcgctctgtcctccgacgagtcactgcaagatcctgccgtgccggtggccatcgaggagatatggatccgccacggcatggccaaggaggccggacacaagttccaggtctgcgcgtcgacccaggagacgggtcgagaccgcattcaggcagctatctcggtggttgatgctcagagggctcgcagcggaccggcgttgacggtccgcggcctgacgtgccagttcctggaccgcgcatcgggagatgtcgagggcgacgagcagcctacacggcttgcatacgagcttcactgggaggcagatgtagacctgctgtcgtcgagcgacctggccacgctgtgtgcggttggccgtccccgtgatgtaggggagaaggtcgctcgatatgtgaagcttctcggacacaagaaccctcatcttgccatcctggaggtcggagccggtcagggagagctgtgtattccggtgtttcgagccctggcaggggaggccaacagcacgccctcgttccagtcatatacactcgccgacaccgagccgggactgtcggagaccattgccacaattgccgaccagtttgacgaacgcgccgatctgattcaatataaggagctcgacatctcgtcggacccgctgcagcagggcttcaacgctcactctttggacctcatccttcttccttcccggggagtgtcggccacgctccgatcgaagatcctcaaacatgcgcaccaattgctcacgcccgaagggagactgattgtggtcgacacgagggacctgcaggaatggtggcaagctcttcgtgagagcaactttactgatccggaagtgattcacgacagtccgagcgagacggaggccgacatctcggtgctggtgtcgaaaccacaaccacaacctcgggatcagaccccatcagaccctccggatgtcctggttatcgccgagaaccaagactccggcgtgtccattgagcatctccagcgtctgctggcggacgctcatgtgccggcgaccgtcacggatttcgctcatgcagacccggagggcaagacgtgcattgttctcagcgagttgacgacctctctgctgagccatcccgaccagcattcgtttgaaacgctcaaaaggatcctcgtcgccgggggtcgcggcgttctctgggtcgttcggggagcaaccggcccagcgcccaccagcagtctggccaccggtctgctgcgcacgattcgctccgagaccgacgatgatcgaccgattgtgagcctggatctggatgcctcccatcccctgtcggcggaatccgcagcgcaatcgatcttctccgcgttccgccaccgattcgtctcccccggagggagtcacgaggtcgaatacgccgaacgcgatgggatcctgcgcatccctcgcgtcgtcgagagttccctcgtcaaccacgagattgtctcgtccttgcggccggcggtggccgaggaccagccattcttccagcccggacgtccgctggaactcaccgtcggcaccccgggacgtctcgacagtctctactatgtcgaccgctcctgcatctcggagctacccagtgactacgtcgagatcgaagtcaaagccatcgggctcgggaacggcgatgtcaagaccgctctgggacatgacgatgccgcaacccgtctcggagcggaatgcagcggtgtggtgactgctctcggggacgccgtttcgggcttcaagatcggagaccgtgtcgctggctttggcgcaggaaccgtcgccactttataccgagaccaggcggcgcggttccagctcatccccgacgacatgagctttgcgcgtgcggccgctctccccgtggcatatatcactgctttcttcgcggtccacgcgctgggccaggtgagccgaggggaccgagtcctcatccaggacgccggcacggccgcgggccaggctctcctggagctctgtgccctcgccgggggggatatcatcgccgtggtggattcgccctcgcaaagagccttcctcgttggcgagtacgacctcccggcgagcagaatcctggtcggtctccgcggacgacgtctagcaaccagcgtcatgacgctgactaggggctgcggagtcgatgccatcttcaatttccgcggaggcgaggagagacgcctgtgctggagctgcgtggcaccatatggccggttcattgacctgggcggcggaccgtccgacctgacggatatgccgcagctcgagatggccagcttcttttccaagaatgcttccttcacggctctggacttccactacctggtcacgcaaaagccacaggcggtgcaccggatctggtccgacgtgatggccctggtgcgagcaaaggccatccggggcccgcccaggcttcaacttcattccgtctccgaggtcgagaccgcgttgaaacagagtcaggacggatgtgatgtcgagaaagtggtgatccgtgccgaacgggatacaatcgtccaggtctgttgccactctgccccttatgatatcctccctcgtgctaatatgttctcttgcaggccattcctcctccgaagggcgacctgctgagggccgacgcgtcatatgtgctagtcggcggcctcggaggcattggacgagcgatggcatcgtggatgattgccaacggagcccgacacttaatctttgtcaaccgcagtggcctcgcccgcaacgaagcccgggagacggtcgagtctctcgagggtcacggtgcccacgtggcggtctattcttgcgatgtcagcgatcgcgaccaagtcgctcagatggttgctcagagctccaaagagatgccgcccattcgaggcgtgattcaggcggccatgattctccgggtatgtctgccttctcgaaattagtaggtcgaggactgactgtagtaggatatgctgtttgagaaaatgagcgtcgacgacttcaacaccgtcctacagcccaaatggcagggcacatggaatcttcatggcctcctaccccgagacatggacttctttatcatgctgtcctccatcagcggggtcatcggcaacgccactcaggctgcctatgccgctggatcgacgttcttgggcgcgttcgcccagtatcgcagctccctgggactaccggccgtgacgctggatctcggcgttatcactggaatcgggtacctgtccgagcacgaggagctgctccagggcatgcagcgacaaggctttgaaggcaccaacgagcagacgctgatggccctcatccgatcagccattgtcagccctcgtcggacggggtcacaagccgagatcgtcaccgggctggggacctggcgagagggcgtctcgctgggcaacttcgaccagcccttgttcgcgcacttccgccgtcaagccctgggactccgagatgccacggcagagggcccgggcaccagcgtccgggagagtctccggggatgcaagaccctcgacgatgcggtggctctggtctgtgcggctctgatcgaccgcctggcctcgagattgaacaccccggtggacaatatcgactcccagcgggcgatgtcggagtacggggtggactcgctggtggcggtggagatgcgcaactggatcggcaaggagatggagagcacgatgcccattctggagctgctggcgaatcaatccatctcgcagttgtcggagaagatagctcagcggtcaaaggtggtggcagtgagtggaagtgaagagtag

SEQ ID NO: 41 - protein, 2451 aa, Paecilomyces divaricatus
MVENVSSPSSPRTSSPSGSCTPTSATSVGSDDKSMPIAVVGMSFRGPRDAISVESLWRMISEGREGWSKIPKSRWNNDAFYHPDHSRHGTINVEGGHFLEEDLARFDAPFFNMTNAEAAALDPQQRLLLESTFEAVENAGIPLDKMLGSKTSCFVGSFCGDYTDMLVRDPEAIPMYQCTNAGQSRAITANRVSYFFDLRGPSVTVDTACSGSLVALHLACQSLRTGDAKMAIVSGVNTILSHEFMSTMSMMRFLSPDGRCYTFDERANGYARGEGVGCLLLKPLSDALRDNDTIRAVIRGTGSNQDGKTSGITLPNANAQQELIRDVYAAAGLDPLETEYVECHGTGTQAGDPLETGAVAKVFSPGRPDDRPLRIGSIKTNVGHLEGASGIAGVIKAVLTLENQCFLPNRNFKSINPRIPLKEWKLKIQLENERWETVGPHRVSVNSFGYGGSNAHAVLEDTKGYLEQRSLTGSFRRVRALPHAATDLEPVSDPGSGPERTRLFVLSSFDQASGQQQIDQLREYLEQNSSRIDDQYLADLAYTLGERRSPFLWKTAMPASSVSSLVEGLKTRAKVSRAEKKKPTLGFIFTGQGAQWCGMGRELLAAYPVFASSVDAIATYLKSLGAPFDVREELVRDPKDSKINQPLYSQPICTAVQIALVDLLTFWGIRPASVTGHSSGELAGAYTAGALSMEHSMAAAYYRGVASSDLPRDHTQRGAMMAVGASKDAIQPRLSSLTTGTAVVACVNSPSSVTISGDASAVDELHGLLEKDQVFARKLAVDVAYHSHHMKAVADQYRTAMAAAGVTAVQPESTEPEVEFFSSVTGEKASLTDLGIEYWVANLLSQVKFADSVHRLCMETSASGRARKTKTKAPKRSGANNKAKVDMLVEIGPHSTLAGPIRQILGADQTLEQASIRYASALLRKSSAVDTTLTLASTLLMAGYPIDMAAINRPSDHHRVGVLVDLPPYPWNHSGSYWAEPRLSKAYRNRAHPRNDLLGVLDTHSSPREPRWRNYLRTSEIPWIKDHMIQSNVVYPAAGYLTMAVEAIGQRIGDNFPGHRISGYRLRDVAIEAALVISDDSEPEVMLSLRPSGDSGLVPAERWHEFHVLSVTPDNRWTEHCRGLICAEVAAMDGDEDDRGAEAGLTAETERWIEEAEQLCQKDVDIPRFYAELTGLGLEYGETFANMTRARSASHVCLAEIEVADTAAVMPLGFQSPFVVHPSTLDSLFHPLFVALSSDESLQDPAVPVAIEEIWIRHGMAKEAGHKFQVCASTQETGRDRIQAAISVVDAQRARSGPALTVRGLTCQFLDRASGDVEGDEQPTRLAYELHWEADVDLLSSSDLATLCAVGRPRDVGEKVARYVKLLGHKNPHLAILEVGAGQGELCIPVFRALAGEANSTPSFQSYTLADTEPGLSETIATIADQFDERADLIQYKELDISSDPLQQGFNAHSLDLILLPSRGVSATLRSKILKHAHQLLTPEGRLIVVDTRDLQEWWQALRESNFTDPEVIHDSPSETEADISVLVSKPQPQPRDQTPSDPPDVLVIAENQDSGVSIEHLQRLLADAHVPATVTDFAHADPEGKTCIVLSELTTSLLSHPDQHSFETLKRILVAGGRGVLWVVRGATGPAPTSSLATGLLRTIRSETDDDRPIVSLDLDASHPLSAESAAQSIFSAFRHRFVSPGGSHEVEYAERDGILRIPRVVESSLVNHEIVSSLRPAVAEDQPFFQPGRPLELTVGTPGRLDSLYYVDRSCISELPSDYVEIEVKAIGLGNGDVKTALGHDDAATRLGAECSGVVTALGDAVSGFKIGDRVAGFGAGTVATLYRDQAARFQLIPDDMSFARAAALPVAYITAFFAVHALGQVSRGDRVLIQDAGTAAGQALLELCALAGGDIIAVVDSPSQRAFLVGEYDLPASRILVGLRGRRLATSVMTLTRGCGVDAIFNFRGGEERRLCWSCVAPYGRFIDLGGGPSDLTDMPQLEMASFFSKNASFTALDFHYLVTQKPQAVHRIWSDVMALVRAKAIRGPPRLQLHSVSEVETALKQSQDGCDVEKVVIRAERDTIVQAIPPPKGDLLRADASYVLVGGLGGIGRAMASWMIANGARHLIFVNRSGLARNEARETVESLEGHGAHVAVYSCDVSDRDQVAQMVAQSSKEMPPIRGVIQAAMILRDMLFEKMSVDDFNTVLQPKWQGTWNLHGLLPRDMDFFIMLSSISGVIGNATQAAYAAGSTFLGAFAQYRSSLGLPAVTLDLGVITGIGYLSEHEELLQGMQRQGFEGTNEQTLMALIRSAIVSPRRTGSQAEIVTGLGTWREGVSLGNFDQPLFAHFRRQALGLRDATAEGPGTSVRESLRGCKTLDDAVALVCAALIDRLASRLNTPVDNIDSQRAMSEYGVDSLVAVEMRNWIGKEMESTMPILELLANQSISQLSEKIAQRSKVVAVSGSEE

SEQ ID NO: 42 - DNA, 709 bp, Paecilomyces divaricatus
atgcgtccagacttgtggcttcttctggccttggtgtgcctccccttgatcgccgcccagacgccaccaggatactggccaaagaccccgaggggcctggatgtcatatttcgtgaccagcagctcattcaaccgggccaattagtccttcccgatggtaatgtgatatattcttccgaccagtcagagctttccccactaatatctgattcgtgtagatgccatcgaccccccggtattcggtcggcaaggtctcagtgtgttccagtcctacctcgccgtgatgatcgacgtcgaagtcaaccacgaaggcaccgcaacgcccctggtgcactggctacagcccgacctgaaggtccgcgatcccttcaccggccggctggcgaggttgagtgatgaggacgtcccctatgtcggcccgcgcccggtccccggccctcgccatacctacgtgctccttttatttgagcagcccacgacatatcgcttccccgaatgcttctcgagcacccggccgatcagcgtcgacacccgctcgggcttcaacctggcccagttcatgcacgtcgcggggttgcaggaacctattgcggcgagttatttcacggctcggaacgaagagacgccctcggcgcctccgccgagagtgacgacaacctcgctgagtaccgcgccttgtgcgactccgactcgatttgtctggtgttga

SEQ ID NO: 43 - protein, 215 aa, Paecilomyces divaricatus
MRPDLWLLLALVCLPLIAAQTPPGYWPKTPRGLDVIFRDQQLIQPGQLVLPDDAIDPPVFGRQGLSVFQSYLAVMIDVEVNHEGTATPLVHWLQPDLKVRDPFTGRLARLSDEDVPYVGPRPVPGPRHTYVLLLFEQPTTYRFPECFSSTRPISVDTRSGFNLAQFMHVAGLQEPIAASYFTARNEETPSAPPPRVTTTSLSTAPCATPTRFVWC

SEQ ID NO: 44 - DNA, 911 bp, Paecilomyces divaricatus
atgtaccaggaagtcgactccatgatcgcccagatagtagaagacgctggaagcctccatcgagctgttgcccaggtggaggagttgaccccgaagcttgttgcagcgagtccttcctccgagaaagtactcgtcccaatcaagaaacaaatcgcagagtgcaaggcagatctcagttcctggaataagagaattgattcattggggctatcgagagcgaaagggatttcagcattcaggaagaggttcaaagcaactgtggacaggtcgtttttcgagaatgtcagaagccggctttgcttccatcgggagcaactgactctgctacttacaaccgccgacgcgtatgtgactctattaccttgccgttatttatccatctaactgttggtcaagtaatgttggagttgagagcctcccgatgacaaacaaatccgagatacgttccaacttcgcgtccgggaaccgggattccaagaacctgtctcgcgtcagctcaccacgattgacaaccggataacagatcaatcagctagtttttttcctctactcaacggcagttcgataggttcttcgatggctatttggagcagggaggacaaactatatgccgtcttgaagctattgatacgaggttgcaatgcctgcaagcccggcttgagcagtcgatcaatccccaaagccagaaaacaacttacaacccgaagaagtctagaagacaagcatatgtacgacagatcccacgcaagacacggttgctggagctcgtgggctcgggaagaggtctctatcatgctcacgaaagacagaccgacattgaagaatttcctctgcgcgtgatacagactgggttgttgctcaccgagcaaaaaggaaagattatgtcgacccttctcgctcttgaggattga

SEQ ID NO: 45 - protein, 228 aa, Paecilomyces divaricatus
MYQEVDSMIAQIVEDAGSLHRAVAQVEELTPKLVAASPSSEKVLVPIKKQIAECKADLSSWNKRIDSLGLSRAKGISAFRKRFKATVDRSFFENVRSRLCFHREQLTLLLTTADAFFDGYLEQGGQTICRLEAIDTRLQCLQARLEQSINPQSQKTTYNPKKSRRQAYVRQIPRKTRLLELVGSGRGLYHAHERQTDIEEFPLRVIQTGLLLTEQKGKIMSTLLALED

SEQ ID NO: 46 - DNA, 1368 bp, Paecilomyces divaricatus
atgtatcccgacgatgaagctcgcaagcgcgtcgataccatgtacatagtgtggacgaggaatctgaagcagtgcttgacagagcgcctagctgccatgctggcagcgaagcatcggggaggcattccgatcgaggctgtcgcgtacagagatggggcctacaatcggtgctacaggatgactttcagagaagggcccgatgccattgtgcggctccccattctgggaaaggtggctctgcggagagagaaagtcaacgacgagttatgcattatggggtatattacccgaaatacttccattcctcttcccaaggtccttggaagtggtatctgtgctgttggcccttacatggtgatgaacttcgccgaagggagtccgcttggagactacctttcggcgcccttgcccgaccgtacccgagtggctgtcttggagccggagattagcatttccaagctgaaaactgcgtaccgcgaaatggcgagagtactgctggagttgtcccgatctcgattctctcgcatcggagcacccacccaaaacacagacggggcctggtccgtctataagcgaccattgacatacaacattaatgagctgctcacatacgcgaatttccctccgcaggacctgcataaaggcccattttccactgcaaacgaatacttcttagccctcgccgaagaccatctgcaacacctgcggacccagcgcaatgacgctgttgacgacgaggcggactgcaagaagaaatatgtggcccggtgtctattcagaaacattgcgcgtaacttctcgaccgcatataataatggtccattcagcttgttctgtgatgacctgcgtccctcaaatgtgcttgtggactcagaccttcatatcacaagcgtcattgactgggaatactgctacgctgcaccgctggagttcacgtattgctctccctggtggctcctgctggcccatccggacagctgggagaatgggttcaacgacttcttcacccagtacatgccccgacagaagatcttcctcgaagtcctgcgagagtgcgaagatgaagccgcagcccgtagcgcggttgtagactcgccgcgactgtctgagcacatggagcagtcgatccacaatggaagtttctggttttgccttgcggccaggtcgagcttctcgttcgatgacatttactgggaattcatcgatcagagatattacggggagtttacctcggttgaggatagaatggcgcttctgagtgaagaggagcgggctgaacttggtggtctttaccacctgaagatggagcaagaagcagagcgtaaattggatgagcatcggacgctagatgagatccttgcttcttga

SEQ ID NO: 47 - protein, 455 aa, Paecilomyces divaricatus
MYPDDEARKRVDTMYIVWTRNLKQCLTERLAAMLAAKHRGGIPIEAVAYRDGAYNRCYRMTFREGPDAIVRLPILGKVALRREKVNDELCIMGYITRNTSIPLPKVLGSGICAVGPYMVMNFAEGSPLGDYLSAPLPDRTRVAVLEPEISISKLKTAYREMARVLLELSRSRFSRIGAPTQNTDGAWSVYKRPLTYNINELLTYANFPPQDLHKGPFSTANEYFLALAEDHLQHLRTQRNDAVDDEADCKKKYVARCLFRNIARNFSTAYNNGPFSLFCDDLRPSNVLVDSDLHITSVIDWEYCYAAPLEFTYCSPWWLLLAHPDSWENGFNDFFTQYMPRQKIFLEVLRECEDEAAARSAVVDSPRLSEHMEQSIHNGSFWFCLAARSSFSFDDIYWEFIDQRYYGEFTSVEDRMALLSEEERAELGGLYHLKMEQEAERKLDEHRTLDEILAS

SEQ ID NO: 48 - DNA, 20 bp, Artificial Sequence
  P1f primer
ggaataagcaggaatggttc

SEQ ID NO: 49 - DNA, 20 bp, Artificial Sequence
  P1r primer
cgcatccattctggagaaac

SEQ ID NO: 50 - DNA, 20 bp, Artificial Sequence
  P2f primer
cgctggatctcggcgttatc

SEQ ID NO: 51 - DNA, 23 bp, Artificial Sequence
  P2r primer
gctgagctatcttctccgacaac

SEQ ID NO: 52 - DNA, 23 bp, Artificial Sequence
  primer sequence
cgacggccagtgaattgtaatac

SEQ ID NO: 53 - DNA, 20 bp, Artificial Sequence
  primer sequence
ggaggtaacccacctttctg

SEQ ID NO: 54 - DNA, 20 bp, Artificial Sequence
  primer sequence
gagccacctttcccagaatg

SEQ ID NO: 55 - DNA, 22 bp, Artificial Sequence
  primer sequence
gctcctatgttgtgtggaattg

SEQ ID NO: 56 - DNA, 300 bp, Artificial Sequence
  300 bp homologous sequences to the 5' flanking region of the cornexistin/hydroxycornexistin cluster "first hook"
gtggttatctgagcgaatttgccggcgcagccagggtagctgagtacggatgcgtgagaatattacctgttaaaggctcaaaatgacaagcatttcctcctgtgggatgcaataccatcttatcagagggtccgttcactcagtgcctgcgatatttattggctcttgagcccctcgattatttccttatctctcatgctcatgttgaggaatctggtaataactccctggtgatcgcttttgcgcgaagacggcacctactcagtacaacttgtgttctttcttgacagttttgcaaag

SEQ ID NO: 57 - DNA, 300 bp, Artificial Sequence
  300 bp homologous sequences of the 3'-flanking region of the cornexistin/hydroxycornexistin cluster
ggctcaaaatgcggtgttatcgataaaaagaggctggacaaccagagctttgtagaagggaggtgaatcggccttagaaccaccccggattgctcctcttctactccgtataatgcgatgtttggacaccagcacgatctgcaggaaaaaggggtccctgactgaaatgaggttagcgccagaaccaggggtgttttggatggagtctgctagattgatcacaacagcagatcctcctaccgagtcaatgaaatatatagatgtcatgcggatttgactatgtctgttattcttgcaaga

SEQ ID NO: 58 - DNA, 3382 bp, Artificial Sequence
  Plasmid pPtrpC-Pcnat1
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatgagctcatttaaatgaattcgaagttcctatactttctagagaataggaacttccgttaactgatattgaaggagcattttttgggcttggctggagctagtggaggtcaacaatgaatgcctattttggtttagtcgtccaggcggtgagcacaaaatttgtgtcgtttgacaagatggttcatttaggcaactggtcagatcagccccacttgtagcagtagcggcggcgctcgaagtgtgactcttattagcagacaggaacgaggacattattatcatctgctgcttggtgcacgataacttggtgcgtttgtcaagcaaggtaagtggacgacccggtcataccttcttaagttcgcccttcctccctttatttcagattcaatctgacttacctattctacctaagcattcatggccaccctcgatgacacggcttaccgctaccgtaccagcgtccccggcgacgccgaagccatcgaggccctggatggctctttcaccacggataccgtctttcgcgttaccgctaccggtgacggcttcacgctccgtgaggtgcccgtcgaccctcccctgaccaaggttttccctgatgacgaatctgacgatgaatccgacgatggcgaggacggcgatcccgactctcgcacgttcgtcgcttacggcgatgacggtgacctggccggctttgtcgttgtgtcctattccggttggaaccgtcgcctgaccgtcgaagacatcgaggttgcccccgagcatcgcggccacggtgtcggccgcgctctcatgggtctcgccacggagttcgcccgtgagcgcggcgccggtcacctctggctggaggttaccaatgtcaacgctcccgccattcacgcctaccgtcgcatgggctttaccctctgcggcctggataccgctctctacgatggcaccgcctccgatggcgagcaggccctctatatgagcatgccttgcccctgagaagttcctatactttctagagaataggaacttcgggcccatttaaatggtaccctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 59 - protein, 1077 aa, Artificial Sequence
  sequence variant 1 of ORF 1_9399
MGSSTFEYDSTPEYGKRFLPHMIDEAAASGHSRPYAYCARSPHPQDGFEEVSYARLANAINRASWEVVNELTPLTGEEGVFAYMGPNDLRYLILSVAAIKTGRKMLQPSMRNTVEAQQLLFQRIGCKTIAYAATLEASLHEIFGSISGLQTKQADSLEDFLSEDVVPHFEYLTSYEELTDEPLIYFHTSGSSGNPKPIGFSLRWLLLFSDAPNLPPINSRPSTVKEGLYRQNTLCLLPPFHAGGFGLAAAVVYFEAIAVCPHPEVAPTAEYILSLLDQNIATALSVPPSLLTALSKTSWGIEALSKLEHVGYVGGPLPEHVGQALKPKAKHLYSLMGATECGWFHTIPGDSSRWAYLRFNPDIGYRFDEISEGVFELVIPNSPVTRKVHGTPHIFPELNEYRTRDLYSLVPGEEGWMRYQGRSDDLIVLSNGEKINPVPLEGIINSHSAILGALIVGEYRFLPSLLIEVQDDFSAETEEERLELLDKIWPTVEQANKIAPRFSRVPKSLIYLTKKDEHFHRAGKGTIQRQRTVSNFAKALDELYSASEQGLPVEELELDDPSNKDSIRAFTRKLYAQALDAEEIKDEDDVFNLGIDSLQVAITVQKIRARMRHRPVELDHEQINGQLIYSNPTAGDLATALNKLVNCEAGPPLDGSQNGVNERSLRLQRLLDKYIAAMPTMLDRAEKANTGGSTVILTGSTGSLGSYLLTTLLSSPAVSKVVCLNRSSDSEKRQRAIHNRRGQHISWEKEDRERVEFLTADLSKPDLGLGDQKYSDLLSEASAIIHCSWKVDFNHTLSSFEATHIAGVINLITLSAKSAIHAPIMFVSSISTVFNWIETHPNLPVPEAIVNDLDSSFKLGYGESKYIGERLIEAYTAATGIQNVVLRVGQIAGPLLSSSGFINKKEWFPSLVASAKHLGLLPESDGTMGTIDWIPVDLLASIITDLLQSVHNEPESEVKSPAVYNLVNPRVTTWPALLHAVCEDLGQQSNVRVVPLSEWVEALERSASHAHGYVIAENPAVKLLDFFLLLGVNGEGNVGEALSQYKVARLLRDSPQARQLGFVSPEWMRMWLKQWKL

SEQ ID NO: 60 - protein, 1077 aa, Artificial Sequence
  sequence variant 2 of ORF 1_9399
MGSSTFEHDQTPEYGKRFLAHMIDEQAASGHSRPYAYIARSPHPQDGFQEVSYARLANAINRASWWVVNELTPLTGENGVFAYMGPNDLRYLILSVAAIKTGRKMLQPSMRNTVEAQQLLFQRIGCKTIAYAATHEKLLHPIITSHSGLQTKQAPSLEDFLSEDDVPHLEYKGSYRKLTDEPLIYFHTSGSSGNPKPIGFSLRWLLLFSDAPNEPPENSRPSTVKEGLYRQNTLCFLPPFHAGGFGLAAAVVYFEAIAVCPHPEVAPTAEYILSDLDQNIATALSVPPSLLDALSKTSAGIEALSKLEHVGYVGGPLPKHVGQALAPKLKHLYSLMGATECGWFHTIPGDSRKWAYLRFNPDIGYRFDEISEGVFELVIPNSPVTRKVPGTPHIFPELNEYRTRDLYSLVPGEEGWMRYQGRSDDLIVLSNGEKINPVPLERIINSHSAIKGALIVGEYRFLPSLLIEVQDDFSAETEEERLELLDKIWPTVEQANKIAPRFSRVPKSLIYLGKKDEHFHRAGKGTIQRQRTVSNYGEALDELYFAGEQGDLVEGLELDDPSNKDSIRAATRKLYAQALDAEEIKDEDDVFNLGIDSLQVAITVQKIRATMRARPVELDHEQINGDLIYSNPTAGDLATALNKLVNCERNVPLDGSLNGENERLTRLQQLLDKYIAAMPTMLTEAEKANIGRSTVILTGSTGSLGSYLLTTLLSSPAVSKVVCLNRSSDSEKRQRAVHNARGQAISGEKEARERVEFLTADLSKPRLGLGDQKYSDLLSEASAIIHCSWRVDFNHTLSSFEATHIAGVINLITLSAKTAHHAPIMFVSSISTVFEWIETHNNLPVPEAILLPIDSSEKLGYGESKYIGERLIEQYTASTGIQNVVLRVGQIAGPVLSHSGFWNKQEWFPQLVASSKHLGLLPESLGTMNTIDWIPVDLLASIITQLLQSVHNSPRSEAKSPAVYNLVNPRVTTWLALLHQVQEDLGLQYNVRVVPLSEWVEALERSASHPDGYVIAENPAVKLLDFFKLLGKDGEGNVGETKSQYKVARLLRDSPQARQLGFVSPEWMRMWLKQWKL

SEQ ID NO: 61 - protein, 1077 aa, Artificial Sequence
  sequence variant 3 of ORF 1_9399
MGSSTFEIDDTPEYGKRFLPHMIDERAASGHSRPYAYIYRSPHRQAGFEEVSYARLANAINRASLWVVNELTPLTGENGVFAYMGPNDLRYLILSVAAIKTGRKMLQPSMRNTVEAQQLLFQRIGCKTIAYAAALEKSLHPILTTISGLQTKYAPSLEDFLSEDVVPHFEYKRSAPKLTDEPLIYFHTSGSSGNPKPIGFSLRWLLLFSDAPNCPQINSPPSTVKEGLYRQNTLNFLPPFHAGGFGLAAAVVYTEAIAVCPHPEVALTAEYILSLLDQNIATALSVPPSLLRALSKTSHGPEQLSKLEHVGYVGGPLPEHVGQALEPKLKHLYSLMGATECGWVHTIPGDSSKWADLRFFPDIGTRFEEISEGVFELVIPNSPVTRKVHGTPHIPPELNEYRTRDLYSLVPGEEGWMWYQGRSDDLIVLSNGEKINPVPLEGIINSHSAIKGALIVGEYRRIPSLLIEVQDDFSRGTLEERLELLDKIRPTVEQANKIAPRFSRVPKSLIRLGKKDEHFHRAGKGTIQRQRTVSNFAKALDELYLNAEQGLLVDPLEVDDPSNLDSIRQRTRKLYAQALDHEEIKDEDDVFNLGIDSLQVAITVQKIRATMRARPVELDHEIINGQLIYSNPTAGDLATALNKLVNCSRGVPLDGSLNGANERSTRLQQLLDKYTAAMPTMTDTAEKANEGRSTVILTGSTGSLGSYLLTTLLSAPAVAKVVCLNRSSDSEKRQRAAHKARGQATSWEKEDRERVEFLTADLSKPDLGLGDQKYSDLLSEASAIIHCSWKVDFNHTLSSFEATHIAGVINLITLSAKSAHHAPIMFVSSISTVFNWIETQPNLPVPEAILNNPPQSESLGYGESKYIGERLILAYTASTGIQNVVLRVGQIAGPVLSSSGFWNTQEWFTSLVASSKELGLFPESTGTMQTIDWIPVDLLASIITQLLQSVHNGPESEVKSPAVYNLVNPRVTTWPALLESVQEDLGGQSNVRVVPLSEWVEALERSASHNHGYVIAENPAEKLLDFFKLLGKNGEGNVGEGKSQYKVARLLRDSPQARQLGFVSPEWMRMWLKQWKL

SEQ ID NO: 62 - protein, 1077 aa, Artificial Sequence
  sequence variant 4 of ORF 1_9399
MGSSTFEHDRTPTYPKRFLWHMIDHGAASYHSRPYAKITRDPHYHDGFQEVSYARLANAINRASWHVKNELTPLTGENGVFAYMGPNDLRYLILSVAAIKTGRKMLQPSMRNTPEAQQYLFQRIGCKTIAYAAGLAKKLHAIGTSISALQQKQAPSYEDFLNEDVPPRFEKKFSWEVLTDEPLIYFHTSGSSGNPKPIGFSLRWLILFSDAPALPSINSIPPAWKEGLYRQNTLVFLPPFHAGGFGLAAAVVYFEAIAVCPHPEDAPTAEYILSLLDQYIATYLYVPPSLLDILSKTSAGIEALSKLEHVGYVGGPLPEHVAQALTPKLKHLYSLMGATECGWFHTIPLDSSKWAELRFSPDIGYRFDEISEGVFELVIPNSPVLRKVHGTPHILPELNEYRTRDLYSLVPGEEGWMRYQGRSDDLIVLSNGEKINPVPLEGIINSHSAISGALIVGLYRFLPSLLIEVSDDFSAETEEERLELLDKIWPTVESANKYAPAFSRVPKRLILLGKKDEHFHRAGKGTIQRQRTVSNFAKALDELYFAASQGLRVKGLELPDRSNKDSIRAFTRKLYAQALDAEEIKDEDDVFNLGIDSLQVAITVQKIRATMRARPVELDHEQINGQLIYSNPTAGDLATALEKLVNCERGVPLDGSLNEVSERSERLQALLDKYIADMPEMLPEAEKANSGRSTVILTGSTGSLGSYLLTTLLSNPAVKKVVCLNRSSDSEKRQRAIHNARGQQVDWQKELRERVEFLTADLSKPGLGLGDQKYSDLLSEASAIIHCSWKVDLLGTLSSFEPTHIAGVINLITLSAKSAHHAPIMFVSSISTVFGWHEVQPNLPVPEAILNDLDSSEPLGYGESKYIGERLIQLYLASSGIQNVVLRVGQIAGPVLSSSGFWNKDEWFPSLVASCKTLGLLPESLGTDNTIDWIPVDLLASIITQLLQSVANEPESEVKSPAVYNLVNPTVYTWPALLHEVQEDLGGKFNVRVVPLSEWVEALERSASHNHGYVIAENPAVKLLDFFKLLGKRGEGNVGETKSQYKVARLLRDSPQARQLGFVSPEWMRMWLKQWKL

SEQ ID NO: 63 - protein, 1077 aa, Artificial Sequence
  sequence variant 5 of ORF 1_9399
MGSSTFEHDKTPNYGKRFLPHMIDERAAKGHSRPYARIARIPHPQDGVEVVSYARLANAINRASWWVNNYLTPLTGENGVFAYMGPNDLRYLILSVAAIKTGRKMLQPSMYNTVEAQQQLFQRIGCKTIAYAATLDKSLHPIFRSKSGLQDKQAPSLEDFLSEAPTGHFEYKVTVTKLTDEPLIYFHTSGSSGNPKPIGFSLRWLTLFSRQPNYLPINSSNGIVKEGLYRQNTLCFLPPFHAGGFILAAPVVYFEAIAVCPHPERLPTAEEILSLLDQNIATALSVPPSLLDALSKDSEGGEALSKLEHVGYVGGPLPEHVGQALAPKDKHLFSLMGATECGWFHTYPADPSKIAYLRFNPDIGYRFDEISEGVFELVIPNSPVTRKVHGTPHIFPELNEYRTRDLYSLVPGEEGWMQYQGRSDDLIVLSNGEKINPVPLEGIINSHSAIKGALIVGIYRFLPSLLIEVQDDYSAETEEERLELLDNIWPVVETANKNAPNFSRVPKSLIYLGKKDEHFHRAGKGTIQRQRTVSNFKKALDDLYFAPEQGLLIEGLELDDPTNKDSIRAFTRKLYAQALDAEEIKDEDDVFNLGIDSLQVAITVQKIRAKMRYRPVELDTEQINGQLIYSNPTAGDLATRLNKLSNCGRGVPLDGSLAGVLERSTRLQQLLDKYIARMPTMLTNAELAKTGRSTVILTGSTGSLGSYLLTTLLSSPAVIKVVCLNRSSDSTKRQPAIHNARGQAIVWEKEDRERVEFLTADLSKPDLGLGDQKYSQLLSEASAIIHCSWQVDFNHTASSFKATHIAGVINLITLSAKAAHHAPIMFVSSISTVFNWIETHKNLNVPEAHPNDLDCSQKLGYGESKYIGERLIEEYTASTGIQNVVLRVGQIAGPVLSSGGFSNVQEWFPALVNSAKHLGLLPESLGTMLTIDWIPVDLLASIITRLLQSVSNSPESEVKSPAVYNLVNPRVRTWPALLHSVEEDLGGQSNVRRVPLSEWVEALERTASHNKGYVIEENPAVKLLDFFKLNGEYGEGNVGTTKSQYKVARLLRDSPQARQLGFVSPEWMRMWLKQWKL

SEQ ID NO: 64 - protein, 342 aa, Artificial Sequence
  sequence variant 1 of ORF 2_9399
MGYLLNLPAELLLLIVNQLDRYDLMNLRVVHRRFSFVNPRVFKVMRFINEPTVPVKLRKLLKREDMRSALDEIIFSTDSLFRGYNTHTAALRPKRVARLLANHDDVNIKTVHLVGDSGGLGLLLRYFAEAGIRSLRYLSGAIIFRHHEINEEWLPHLMDESGVLEVLGGLERLDLTLNNRSGFIWHPRGFSPHDFPAIYSIMAKTPSLTQQLLKRIEGQDFSDMAGCFMFFRRRSAFPPRLDKVTVERCHTPLIFLTRIINHPSWEDVTLSSVSLILDRSEGIDARRYYIRKWQDFLEAFSDYYYDGEETRKRLTVGELWERGNLATIDVNHLLGVTLLDPN

SEQ ID NO: 65 - protein, 342 aa, Artificial Sequence
  sequence variant 2 of ORF 2_9399
MGYLENLPAELLLLIVDQLDEKDLMNLRVVHRRFSFNNPRVFKVMRFYNEPTVPVKLRTLLKREDMRSALDEIIFSTDSLFRGYNRHDLALRLKRVARLLANHDDVNIKTVHLVGDSGGLGLLLRYFAEAGIRSLRYLSGAIIFRHHEINRTWKRHLMDGSGVLEVLGGLERLDLTLNNRSGFISQPIGFSPHDFPNIYSIMAATPSLTELLLKGIEGQDFSDMLGCFMFFRRRSAFPPRLRTVPVERCHTPPSFLTRIINDPNIEDVTLSSVSLILDRSEGIDARRYYIRKWQDFLEAFSDIYYDGEETRKRLTVGELWERGNLATIDVNHLLGVTLLDPN

SEQ ID NO: 66 - protein, 342 aa, Artificial Sequence
  sequence variant 3 of ORF 2_9399
MGYLDNLPAELLFLIVDQLDRYDLMNLRVVHRRFSFVSPRVFKEMRFYNEPKVPDKLRKLLKREIMRSALDKIRFPTDSLFRGYNEHDAGLSLKRVARLLANHDHVNIKTVHLVGDSGGLGLLLREFAEAGIRSLRYLSGALIFRHHEINEKILPHLMDDSGVLEVLGGYERLDLTLNNRSGFISCPRGFSPHDFDNIYSIMAATPSLTELLLKVIEGQDFSDMLGCFMFFRRRSALPPRLRKVTVERCHTPLSFLTRIINHPSPEDVTLSSVSLILDRSEGIDARRYYIRKWQDFLEAFSDIYYDGEETRKRLTVGELWERGNLATIDVNHLLGVTLLDPN

SEQ ID NO: 67 - protein, 342 aa, Artificial Sequence
  sequence variant 4 of ORF 2_9399
MGRLENLPAELLFQIVKQLDRYDLMNLRVVHRRFSFKNPRVFKVMRFRNERTIMVKLRNLLKREDMASALDTIIFSGDSLFRGYNRHDVALVSKRVARLLVNHDSVNIKTVHLVGDSGGLGLLLRYFAENGIRSLRYLSGAIIFAKHEINEEWLAHLMDYSGVLEVLGGLERLDLTLNNRSTFNSHPLGNSPHGFLNIYSIMATTPSLTELLLKGIEGEDFSSMLGCFMTFRRRSAFPPRLRPVTVERCHTPTSFLTRIINHPSIEDVTLSSVSLILDRSEGIDARRYYIRKWQDFLEAFSDAYYDGEETRKRLTVGELWERGNLATIDVNHLLGVTLLDPN

SEQ ID NO: 68 - protein, 342 aa, Artificial Sequence
  sequence variant 5 of ORF 2_9399
MGPLLNLPAELLFLIVDQLDRRDLMNLRVVHRPFSFVNPNVFKVMRFYESPTEPVKLRKLLKREDMRSALDRIDFSADGLFRGYNRHDAALPLKRVARLLVAMDDVNIKTVHLVGDSGGLGLLLRYFAEAGIRSLRLLSGATLFRVHSINEEYLPHLMDESGVEEVLGGLERLDLTLNNRSGPITHPRGFSPHKFPNIYSIMATTPSLTETLLKGIQGQDSSDMVGCFMFIRRYSAFPPRLRGVTVRRCHTPLSFLTRIINHPSIEDVTLSSVSLILDRSEGIDARRYYIRKWQDFLEAFSDIYYDGEETRKRLTVGELWERGNLATIDVNHLLGVTLLDPN

SEQ ID NO: 69 - protein, 243 aa, Artificial Sequence
  sequence variant 1 of ORF 3_9399
MLTTVKTPNAVQNIEILARRYGDIQANAANINTPCDCIHGMVQVMGELPDHYPVSFDTILSLGADITTQCNHMVACEHCETHWHAIITLQCVLDLGLALYEEAFSAYQLGEGDLRSPERLGTGRRSRSSTLSLPRPPGSSSGGADGLASADDFPGTMNGPPVCCTSPMTWGDIEIHEEDAQLLAKYLLTKRLDDLGELIGELKLILENVWHRNRQQQSFSLQECEDSLMVSMDRLVTLVGLLR

SEQ ID NO: 70 - protein, 243 aa, Artificial Sequence
  sequence variant 2 of ORF 3_9399
MLTTVKTPNAVQNIEILARDYGDIQANAANINTPCDCISGMVQVMGKLPDPYPVSFDTILSLGADITTQCAHMVACEHCVTHWRAIITLQCVLDLGLALYEGAFSACALGEGDLRSPERLGTGRRSRSSWLSLPRPPGSSSDGADGLASADDFPGTMNGPPVCCTSPMTWGEIEINEEDAQLLAGMLLRRRLADLKADIEELYLILENVWHRNRPQQSFSLQECEDSLMVSMDRLVTLVGLLR

SEQ ID NO: 71 - protein, 243 aa, Artificial Sequence
  sequence variant 3 of ORF 3_9399
MLTTVKTPNAVQNIEILARRYGDIQANAANINTPCDCIHEMVQVMGKLPDHYPVSFDTILSLDADITTQCAHMVACEHCKTHWHAIITLQAVLDLGLQLYEGAFSAYALGEGDLRSPERLGEGRRSRSSTSSRPRPPGSSSDGADGLASASDFPETMNGPPFCCRSPMTWGWIEIHEEDGQLLAGMLLRRRLADLGKLIEELKLKLENVWHRNRPQQSFSLQECEDSLMLSMDRLVTLVGLLR

SEQ ID NO: 72 - protein, 243 aa, Artificial Sequence
  sequence variant 4 of ORF 3_9399
MLTTVKTPNAVQNIEILARRYGDIQANAANINPPCDCITGMVQVMGKLPDHYPVSFDTILSLGADITTQCATMVACEHCVTHWVAIITLQCVLDLGLALYESAFSAPALGTGDLPSPERLGTGRRSRSSSASLPRPPGSSSRGADDLASAHDFPGTLNGPPVCCASPMTWGDIEIHEKDARLLAGALLRRRLVDLEKLIGELSLILENVAHRNRPQQSFSLQECEDSLSVSMDRLVTLVGLLR

SEQ ID NO: 73 - protein, 243 aa, Artificial Sequence
  sequence variant 5 of ORF 3_9399
MLTTVKTPNAVQNIEILARSYGDIQANAANINTPCDCIHGMVQVMGKLPDHYPVSFDHILSLVADIMTTCYHMVACKHCRTHWHAIITLQCVLDLGLFLYEGAYSAYALGVGDLDSPERLGTGRRSRSSTLSLPRPPGSSSDGAMALASADDFPPTMNKPPVCVTEPMTWGDIEIHEEDARLLAGALLRRHLADLGALIGELKLILENVWHRNRDIQDFSLQECEDSLARSMDRLVTLVGLLR

SEQ ID NO: 74 - protein, 305 aa, Artificial Sequence
  sequence variant 1 of ORF 4_9399
MSHKLSLNDGVLMPTLAFGVGTDFLKRSGSDALHRPTVDAVKEALRVGYRHLDTAEMYNTEAVVGAAIHEDIAEGIVQGRDELFITTKVSSDRLQISKSIDVSLQKLKLDYVDAYLIHTPYEAESDDDLDKAWKGMEEVKASGKARTIGVSNFQSEHLRTVLAYAQTPPSVNQLEFHPYLSVIDGNDYLFSLRDNMRDITISAYGALAPITRNIGIQRDETLKEVANRYGVGTDLVCLRWCIEQGVATITTSRHEDRMKGYLRVLDFQITPDEVMQIGASAQACLGDKEQPLTRIEKYHMAQKHT

SEQ ID NO: 75 - protein, 305 aa, Artificial Sequence
  sequence variant 2 of ORF 4_9399
MSHKLSLNDGVLMPTLAFGVGTAFLKRNGRYAFHRPTVDAVKEALRVGYRHLDTAEMYNTELEVGAAIHESIYEGIVQGRDELFITTKVSSDFLNISKSIDVSLQKLKLDYVDAYLIHTPYIAESDDDLQKAWKGMEEVKASGKARTIGVSNFQSKHLRTVLATAQEKPSVNQLEFHPYLEQRDGNDYLSSLRDNMRDITISAYGALAPITRNIAGKLDEFLKEVANRYGVGTDLVCLRWCIEQGVATITTSRHEDRMKGYLRVFDFQITPDEVMQIGASAQACLGDKAQPLTRIEKYHMAQKHT

SEQ ID NO: 76 - protein, 305 aa, Artificial Sequence
  sequence variant 3 of ORF 4_9399
MSHKLSLNDGVLMPILAFGVGTFFLKWSGSPKLHRPTVDAVKEALRVGYRHLDTAEAYNTELAVGAAIHECIAEGIVQNRDELFITTKVSSDFLSISKSIDVSLQKLKLDYVDAYLIHTPVLAESLDDLQKAWKGMEEVKASGKARTIGVSNFTSTHLRTVLAFAQTPPSVNQLEFHPYRSVPDGNDYLFSLRDNMRDITISAYGALAPITRNIPGPLDETLKVVANRYGVGTDLVCLRWCIEQGVATITTSRHEDRMKGYLRVFDFQITPDEVMKIGASAQACLGPKYQPATRIEKYHMAQKHT

SEQ ID NO: 77 - protein, 305 aa, Artificial Sequence
  sequence variant 4 of ORF 4_9399
MSHKLNLNDGVLMPTLAFGVGTAFRKNSESDALHRPTADAVKEALRVGYRHLDTAEMYNTESEVGAAIHENIAEGIKAGRDELFITTKVSADFLVISKSIDVSLQKLKLDYVDAYLIHTPYWADSTHQLQKAWKGMEEVKASGKARTIGVSNFGSTHLRTVLATAQSTPSVNQLEFHPYLNPRDGNDYLFSLRDNMRDITISAYGALAPIPRKYPDPLAENLKEVANRKGVGTDLVCLRWCIEQGIATITTSRHEDRMKGYLRVFDFQITPDEVMAIGASAKSCLGDKEQPLTRIEKYHMAQKHT

SEQ ID NO: 78 - protein, 305 aa, Artificial Sequence
  sequence variant 5 of ORF 4_9399
MSHKLSLNDGVSMPTLAFGVGGAFQKRSGSDADHRPTVDAVLEALRVGYRHLDTAEMYNTELEVGAAIHDSIAEGIVQPRDELFITTKVSSDRLNILESIDVSLQKLKLDYVDAYLIHNPYWVVSDYDLQKAWKGMEEVKASGKARTIGVSNFQSKMLRQVLATAQTPPRVNQFEFHPYNSVQDGNDYLYSLKDNMRDITISAYGALAPITRAIPDQLDETLKEVADRYGVGTDLVCLRWCIEQGVATITTSRHEDRMKGYLRVFDFQITPDEVMQIGASNQAYLGDKEAPLVRIEKYHMAQKHT

SEQ ID NO: 79 - protein, 640 aa, Artificial Sequence
  sequence variant 1 of ORF 6_9399
MSSYKFPVDLKQFKQLKLDPKSPQLSAQQKNDLLHNINIFRDAIIHFTATGAARGLAGHTGGPFDTAPEVCILLAFMNVNPDKFVDALYDEAGHRVATQYLLAALDGKIDPDHLLNYRAADSKLPGHPELGLTPGIKFSSGRLGHMWAMCNGISMARKDKNVLLLGSDGSQQEGNDAEAARIAVAKNLKVKLFIDNNDVTIAGHPSAYLKGYEIAMTLEGHGLKVIRAQGENLDSLDAAMCEIINYNGPAAVVVDRKMAAGIEEIEGETPSHDAIPVSIARKYLTKRGYEAELLAWYDQIKPGKNPAQYQGSTKEKGANRAIFGEAVNSVLDGLSKEERVRRVMVIDSDLAGSTGLKDIQSKHPEVFVASGVMERGNFSAAAGFGFGSNGERQGVFSTFSAFLEMCVSEITMARLNRCTVLSHFSHSGVDEMADNTCHFGLNLFFADNGLMDAESTSLYFPADGEQMAAVVNKVFWDQSMRFIFSTRSKVPYILKAGTDQKLYGDGYEFVQGKEEVIRKGTAGYVVSYGDMLYRSLDAVEMLRKEGLDVGLINKPTLNIVDEDTIIVYGSTPFVVVVESINQKTGLGSRLGSHLLEKGLEPKFKRIGLVREGSGGLYEQINAQGLGPNDIIAAVKEVSGK

SEQ ID NO: 80 - protein, 640 aa, Artificial Sequence
  sequence variant 2 of ORF 6_9399
MSSYKFPVDLKQFKQLKLDPKSPQLSAQQKNDLLRNINIFRDAIIAFTATGAARGLAGHTGGPFDTAPEVCILLAFMNANPDGPVDALYDEAGHRVATQYLLAALDGKIDPDHLDNYRAADSKLPGHPELGLTPGIDFSSGRLGHMWAMCNGISMAHKDKNVLLLGSDGSQQEGNDAEAARIAVAKNLKVKLFIDNNQVTIAGHPSIYLKLFEIARTLEGHGLKVIRAQGENLDSLFGAMCHIINYNGPAAVVVDRKMAAGIEEIEGETHGHDVKPVDIALKYLTKQGYSKLQLAFYDQIKPGSNPSQYQGSTKEKGANRAIFGEAVNSVLDGLSKEERVRRVMVIDSDLAGSTGLKAISSKHPEVFVASGVMERGNFSVAAGFGFGSNGEIQGVFSTFSAFLDMCVSEITMARLNKCTVLSHFSHSGVDGMADNTCHFGLNLFFADNGLMDAESTSLYFPADGEQMKGVVKKVFDCKSMRFIFSTRSKVPYILKIGEDQKLYGDGYEFVPGKEEVIRKGSAGYVVSYGDMLYRSLDAVERLRKEGLDVGLINKPTLNIVDEDTIKVYGSTPFVVVVESIAAKTGLGSRLGSHLAERKLTPKFKAIGAVHEGSGGLKEQINAQGLGPNDIIAAVKETSGK

SEQ ID NO: 81 - protein, 640 aa, Artificial Sequence
  sequence variant 3 of ORF 6_9399
MSSYKFPVDLKQFKQLKLDPKSPQLSAQQKKDLLHNINIFRDIIIAFTATGAARGLAGHTGGPFDTAPEVCILLAFMNANPDGFVDALYDEAGHRVATQYLLAALDGKIDPDHLRNYRAADSKLPGHPELGLTPGIKFSSGRLGHMWAMCNGISMAHKDRNVLLLGSDGSQQEGNDAEAARIAVAKNLKVKLFIDNNLVTIAGHPSDYMKGYEIARTLEGHGLKVIRAQGENLDSLYGAMCQIIIYNGPAAVVVRRIMAAGIEEIEGETFAHDVIPSDEERKYLVEKGESKEILAFEDQIKTGSLPHQYQGSTKEAGANRAIFGEAVNSVLDGLSNEERVRRVMVIDSDLANSTGLKAIHSKHPEVFVASGVMERGNFSAAAGFGAGSNGELQGVFSTFSGFLEMCVSEITMARLNRCTVLSHFSHSGVDEMTDNTCHFGLNLFFADNSLMDAESTSLYFPADGEQMKAVVEKVFWLKSMRFIFSTRSKVPYILKEGTDQALWGDDYEFVPGKEIVIRKGSAGYVVSSGDMLYRSLDAVERLRKEGLKVGLINKPTLNIVDEDTIVVYGSTPFVVVVESIAQRTGLGSRLGSWLLERKLTPKFKAIGAVREGSGGLYEQINAQGLGPNNIIAAVLEVSGK

SEQ ID NO: 82 - protein, 640 aa, Artificial Sequence
  sequence variant 4 of ORF 6_9399
MSSYKFPVDLKQFKQLKLDPKSPQLSAQQKNDLLHNINIFRDFIIMFTMTGAARGLAGHTGGPFDTAPEVCILLAFMNANPDGFVDALYDEAGHRVATQYLLAALDGKIDFDHLWNYRAADSTLPGHPELHLTPGIKFSSGRLGHMWAYCNGISMAKKDKNVLLLGSDGSQQEGLDAEAARIAVHLNLKVKLFIDNNDVTIAGAPSIYNAGYEISRTLEGHGLEVIAAQGENLDSLYGAMCEIINYNGPAAVVVDRKMAAGIEEIEGQGHAHDKAPVDINRKYLTKRGYSKEQLAYYEQIPQGSIPEQYQASPKLKGANRSIFGNAVNSVLAGLSDEARVRRVMVIDSDLAGSTGLKYIQSKHPEVFVASGVMERGNFSAAAGFGFGSNGERQGVFITFSAFLEMCVSEITHARLMRCTVLSHFSHSGVDVMADNTCHFGLNLFFADNYLMDAESTSLYFPADGYQMRAVVNKVFHDKSMRFIFSTRSKVPYILKDKEDGKLYEDGYEFVPGKEEVIRKGSAGYVVSYGAMLKRSLDAVERLRKEGLDVGLINKPTLNIVDEDTIKVYGSTPFVVVVESIALKTGLGSRLGSHLLESKLNPKFDAIGIVREGKGGLGEQINAQGLGPNDIIEAVRKLSGK

SEQ ID NO: 83 - protein, 640 aa, Artificial Sequence
  sequence variant 5 of ORF 6_9399
MSSYKFPVDLKQFKQLKLDPKSPQLSEQQKNDLLHNINIFRDAIIAFTATGAARGLAGHTGGPFDTAPEVCILLAFMNANPDGFVDALYDEAGHRVATQYLLAALDGKIDEDHLLNYRAADSKLPGHPELELTPGIDFSSGRLGHMWALCNGISMALKDWNVLLLGSDGSQQEGNDAEAARIAVPKNLKVKLFIDNNDVTIAGPPSDYMKPNDIADTLEGHGLEVIFAQGENLDSLVGAMCRIIEYNGPAAVVVVRKMAAGIEEIEGDTGAHDVIPVDIARKYFRGRGYSKRILAFYDQIEQKQNPHQYQGSTKESLAFRAIFGEAVNSVLKQLSAEDEVRRVMVIDSDLAGSTGLKAILEKHPEVFVASGVMERGNFSAAAGFGFGSNSEYQGVFATFSVFLEMCVSEITMARLNRCTVLSHGSHSGVDEMADNTCHFGLNLFFADNGLMNAESTSLYFPADGVQMKAVVRKVFWLKSMRFIFSTRSKEPQILKEGLDQKLYGDGYEFSPGKEEVIRKGDAGYVVSVGDMLYRSLDAVEILRKEGLDVGLINKPTLNIVDEDTIKYYESTPFVVVVESIAQKTGLGSRLGSHLNERKQTPKFKAIGGVREGSGALYEQINAQGLGPNDIIAAVKEVSGK

SEQ ID NO: 84 - protein, 500 aa, Artificial Sequence
  sequence variant 1 of ORF 7_9399
MDLLKELSAPSLAPSLLGTGVVLVVLYFLTVSIQLRIPPFDAPVVSHAIGFLAALQEGKAKYRNIPFFLNTPHHPTVILPRKWWEELKSLPESHISFEAERLDRWGFGNPIALVDHVTIETTKNELTRFTARVFPPLLDETVYAVDKHIGPCVDWTPITVYPTDAQLIALLSSRAFVGLPLSRNERWLEIMIRYGHLSKAAARALWPYPFLLRPILQRFAPQEKELAKQRKEASALVRPILEQRLADLKRPDVKPPNDMMQWVLHRDKPAEREDIDFLVQDQLTLSIVSIHTTAHNLTHCIFLLAAHPECIEPLRQEFLPLLRETNGQIDEQLLTKCNKLDSFCKESQRFCPPGLIVMSRKIMSDIPMSNGTTLPKGLFVATSNYDATSDESVLGNPDQFDAFRYERMRLQDQQRNLHQLVSTSTSELSFGFGTHACPGRFFAAFEIKMILIYLLLNYDLKFQEGVPPPRNEILVTAVMPSFQGKVMMKRRREKIGWHVD

SEQ ID NO: 85 - protein, 500 aa, Artificial Sequence
  sequence variant 2 of ORF 7_9399
MDLLKELDATSLAPSLLGTGVVLVVLYFLTVSIQNRIPPFDAPVVSHAKGFLAALQEGKAKYRNQPFILNTPHHPTVILPRKDWEELKSLPESRISFEAERLYRWGKGNPIALHDHVTIETTKNELTRDTARSFPLLLDETVYAVDKHIGPCVDWTPITVYPTDDRLIALLSSRTFVGLPLSEDERWLEIMIRYTILSKAAMRALVPYPFLLRPILGRFLPQSKELEKDRKEASALVRPILEQRLADLKGPDFKKPNDMMQWVLHNCTPAEREDIDFLVYIQLTLSIVSIHTTAHNLTHCIFDLAAHPECIEPLRQEFLPLLREDNGQIDKQLLTKCNKLDSFCKESQRFCPPGLIVMSRKIRSDIPMSNGTILPKGLFVATSNYDATSDESVLGNPDQFDAFRYERMRLQPQQRNLHPLVDTNTSELSFGFGTHACPGRFFAAFEIKMILIYLLLNYDLKFQEGVPPPRNEILMVAVMPSFQGKVMMKRRREKIGWHVD

SEQ ID NO: 86 - protein, 500 aa, Artificial Sequence
  sequence variant 3 of ORF 7_9399
MDLLRELDAPSLAPSLLGTGVVLVVLYFLTVSIQNRIPPFDAPVVSHAKNFLAVLQEGKAKYRNQPFILYTPHHITVILPRKWWEELKSLPETHISFEAIRLYVWGKGNPIALNDHVRIETTKNELTRLTARSFPLLLDETVYAVDKHLGPCVDWKPITVRPTDLQLIALLSSRTFVGLPLSLNERWLEYMIRYTILSVAAARALWWYPRLLRRILQRFTPQSKELEKARKTASALVRPILEQRLADLKRPDGGPPNDMMQWVLHNLTPAEREDIDFLVDQQLTLSIVSIHTTASNLTHCIFDLAAHPECIEPLRQEFLPLLRETNGQIDKQLLEKCNKLDSFCKESQRFYPPGLIVMSRKIMSDIPMSNGTHLPKGLFVATSNYDATSDESVLGNPDQFDAFRYERSRLQPQQRELHQLVSTSQSELSFGFGTHACPGRFFAAFEIKMILIYLLLNYDLKFQEGVPPPRNEILVTAVMPSDQGKVMMKRRREKIGWHVD

SEQ ID NO: 87 - protein, 500 aa, Artificial Sequence
  sequence variant 4 of ORF 7_9399
MDLLAELDAPSLAPSLLGTGVVLVVLYFLTVSIQNRIPPRDAPVVSHALGFLSALQEGKAKYRNQPFRLNTPHHPTVILPRKWWEELKGLPESHISFEAERLYRWGKGNPIAKMDHVTIETTKNELTRHTARSFPSLTDETVQAVLKHVGPCTDWRPITVYPTDRFLIALLSSRTFVGIPYSRNERWLEIMRRFTRLSKAAARMLQVYPFLLRPILQRFAPQSKEIERQRAGASALVRPILEQRLADIKRPEFSPPNDMMQWVLHNEQPAEREDIDFLVQQQLTLSIVSIHTTAHNLTHCIFCLARHPECIEPLRQEFLPLLREGNGQIDKQLLVKCNKLDSFCKESQRFCPPGLIVMSRKIMSDIPMSNGTTLPKGLQVATSIYDATSDESVLGNPDQFDAFRYERARLQPQQPKLHQLVSTSRAELSFGFGTHACPGRFFAAFEIKMILIYLLLNYDLKFQEGQPVPRNEILVTAVMPSFQGWVSMKRRREKIGWHVD

SEQ ID NO: 88 - protein, 500 aa, Artificial Sequence
  sequence variant 5 of ORF 7_9399
MDLLKELDAPSLAPSLLGTGVVLVVLYFLTVSIQNRIPPWDAPVVSHAPNFLDALQEGKAKYRNQPFILNTPHMPTVILPRKWWEELKSSPESHISFEAQRTYFWGKGKPIAQDDHVTIETTKNALTRETNRSFPMLLDETVYAVDKHIGPCVDWTPITVVKTDLQLIALLSSATFVGLPLSRNETWLESMIRYTILSKAAARALWPYPFLLRPILQPFAPGSKYLEKQRIEASALVHPILEQRLADLKRPDFKPPNDMMQHVLENCVPAEREDIDFLVNQQLTLSIVSIHTTAHNLTHCIFYLAAHPECIEPLRQEFLPLLRETNGMIDEQLLTKCNKLDSFCKESQRFWPPGLIVMSRKIFSDIPMPNGTILPKGLQVATSAYDATSDESVLGNPDQFDAFRYERPRLQPQQRRLHQLSSTHTSELSFGFGTHKCPGRRFALFEIKMILIYLLLNYDLKFQEGVPPPKNIISVTAVKPSFQGKVMMKRRIEKIGWHVD

SEQ ID NO: 89 - protein, 424 aa, Artificial Sequence
  sequence variant 6 of ORF 7_9399
MDLLKELDAPSLAPSLLGTGVVLVVLYFLTVSIQNRIPPFDAPVVSHAKGFLAALQEGKAKYRNQPFILNTPHHPTVILPRKWWEELKSLPESHISFEAERLYRWGKGNPIALVDHVTIETTKNELTRHTARSFPLLLDETVYAVDKHIGPCVDWTPITVYPTDLQLIALLSSRTFVGLPLSRNERWLEIMIRYTILSKAAARALWPYPFLLRPILQRFAPQSKELEKQRKEASALVRPILEQRLADLKRPDFKPPNDMMQWVLHNCTPAEREDIDFLVQQQLTLSIVSIHTTAHNLTHCIFDLAAHPECIEPLRQEFLPLLRETNGQIDKQLLTKCNKLDSFCKESQRFCPPGLIVMSRKIMSDIPMSNGTILPKGLFVATSNYDATSDESVLGNPDQFDAFRYERMRLQPQQRNLHQLVSTR

SEQ ID NO: 90 - protein, 424 aa, Artificial Sequence
  sequence variant 7 of ORF 7_9399
MDLLKELDAPSLAPSLLGTGVVLVVLYFLTVSWQNRIPPFDAPVVSHAKGFLAALQEGKAKYRNQPFILNTPHHPTVILPRKWWEELKSDPESHISFEYEALYRWGKGNPIALVDHVTIEATKNELTRHTANMTPLLLDETVYAVDKHIGSCVDWTPITVYPMDLQLIALLSSRTFVGLPLSRNERWLRIMIRYTRLSKAAARALWPYPALLRSIWQRFAPQSKELEKQRKEASALVRPILEQRLADLRRPDFSPPNDMMQWVLHNCPPYEREDIDFLVQQQLTLSIVSIHTTANNLTHCIFDLAAHPECIEPLRQEFLPLLRETNGQIDKQLLTKCNKLDSFCKESQRFCPPGLIVMSRKIMSDIPMSNGTILPKGLFVATSNHDATSDESVLGNPDQFDAFRYERMRLQPAQRNLHQLVSTR

SEQ ID NO: 91 - protein, 424 aa, Artificial Sequence
  sequence variant 8 of ORF 7_9399
MDLLKELLMPSLAPSLLGTGVVLVVLYFLTVSAQNRIPPFDAPVVSHAVGFLDALQEGKAKYRNQPFILNTPHHPTVILPRKWWEELKSLPHSHISFEVERLYRWGKGVPIALPDHVTIETTKNELTRHTARSFPLLLDETVYAVDKHIGPCVDWTPITVYMTDLQLIALLSSRTFVGLPLSRNERWLEDMIRVTILSQNAARALWHYPFLLRPILQRFAPQSKEYEKRRKEASALVKPILEQRLADLKRPDFKPPNDMMQWVLHNCTPGENEDIDFLVQQQDTLSIVSIHTTAHNLTHCIFDLAAHPECIEPLRQEFLPLLRETNGQIDKQLLTKCNKLDSFCKESQRFCPPGLIVMSRKIMSDIPMSNGTILPKGLFVATSNYDATSDESVLGNPDQFDAFRYERHRLQPQQRNLHQLVSTR

SEQ ID NO: 92 - protein, 424 aa, Artificial Sequence
  sequence variant 9 of ORF 7_9399
MDLLKLLDAPSLAPSLLGTGVVLVVLYFLTVHFQNRIPPFDAPVVSHAKGFLAALQEGKAKYRNQPFILWTPHHPTVILPRKWWEELKSLPESQISREAEQLYRWLKRNPIALMDHVTIETTKNELTRHTARSFPLLLDETVYAVSKHIGPCADWTPITVYPTDLRLIALLSSRTFVGLPLSENERWQEIMIRYTILSKSAARALWPYPFILRPILQRFAPQSKELEKQRKEASALVRPILEQRLAALKRPTKKPPNDMMQWVLHNCTPAEHEDIDFLVQFQLTLSIVSIHTTAHNLTHCIFTLAAHPECIEPLRQEFLPLLRETNGQIDYQLLTKCNKLDSFCKESQRFCPPGLGVMSRKILSDIPMKNGTILPKGLIVGTSNYDATSDESVLGNPDQFDAFRYERMRLQPQQRTLHQLVSTR

SEQ ID NO: 93 - protein, 424 aa, Artificial Sequence
  sequence variant 10 of ORF 7_9399
MDLLKELDAPSLAPSLLGTGVVLVVLYFLTRLWLNRIPPFDAPVVSHAKGFYPALAEGKAKYRNQPFILNTPHGTTVILPRKWWEELKSQPESHISFTAERLYIWGKFNPIALVDHVTIETTKNELTRHTARSFPILLEMTVYAVDEHIGPCVDWTPITVYPCDLSLIALLSSRTFVGLPYPENERWLEIVIRFTILSKAAARAVWPYPFCLRPILQRFAPQSKEGLKQRKNALALVRPILEQRLADLKSPDSKPPNDMMQWVLHSHTPAEKEDIDFLLQQQFTLSIVSIHTTAHNLTHCIFDLAAHPECIEPLRQEFLPLLRFTNGQIDKQLLTKCNKLDSFCKESQRFCPPGLIVMSRKIMSDIPMSNGTSLPKGLAVATSLYDATSDESVLGNPDQFDAFRYERERLQPPQRNLHQLVSTR

SEQ ID NO: 94 - protein, 424 aa, Artificial Sequence
  sequence variant 11 of ORF 7_9399
MDLLKELDARSLAPSLLGTGVVLVVLYFLTVSIQTRIPPFDAPVVSHAKGFLAALIEGKAKYRNQPFILNTPHHPTVILPRKWWEELKSLPESHISFYKRRLYRWGKVTPIALVDHVFIEETKNELTRHTATSFPLLLDLTVYAVDKHIGNPVDWTPITVNPTDCQLIALLSSRTFVGLPFSRNERWLEASIRYTILSRAQARLLAPYPFLLKPILQRFGPQSKEVEKQSKEAIALVKPILEQRLADLKAEDFKEVNDMMQSVLHACEPAEREDIDFLVQLQLTLSIVSIHTTAHNLTHCIFDLAAHPECIEPLRQEFLPLLRETNGQIDYQLLTKCNKLDSFCKESQRFCPPGLIVMPRKIMSDIPMRNGTLLPKGLFVATSNYDATSDESVLGNPDQFDAFRYERGRLQPEQRNLHQLVSTR

SEQ ID NO: 95 - protein, 502 aa, Artificial Sequence
  sequence variant 1 of ORF 8_9399
MSAEAEKQSSSPADSSLQTIHDPRDQPPGDAEDPTLILEDGFDDPANPKNWSRRRKPAATMVVSGFNFIEPLANAMIAPCLPALAAELDITSSVEQSMALSVFVLGYAVGPLVVGPLSELYGRVPVLQTSNLVFLLFNLAIGLATTKGEMIAFRFIAGLGGSAPQATGFGVLGDLWATEMRGRALAFYSLAPLLGPAVGPIAGGFVAENTSWRWIFYATTISNGVVMLLGFLLLQETRASVLLERKKRRRIKETGSKAWQTEWDLPPHTARNIILIALNRPFRLLFTQPIVQVLAVYLAYNYGILYLVLASFPDLWVSPDHYGESVGIGGLNYIALACGFLLGAYLCAPTQDRIYRRLKDRNGGVGRPEYRIPLMIPSAILVPVGLFIYGWTPEYRTTWIGPDIGIALYAAGYITSFQCVQVYIVDVYTNYAASALASSTVLRSLCAFTFPLFAPKMYDALGYGWGNSMLAFIAMGLGWPGPFVLWRYGQALRERTPYAAEI

SEQ ID NO: 96 - protein, 502 aa, Artificial Sequence
  sequence variant 2 of ORF 8_9399
MSAEAEKQTSSPALASLQTLQDDRDQPPGDAEDVTLITWDGPDDTANPKNWSGRRKWAATMVVSGFNFIQPLAIAMIAPCLPALAAELDITSGVEQSMALSVFVLGYAVGPLVVGPLSELYGRVPVLQTSNLVFLLFNLACGLARTKGEMIAFRFIAGLGGSAPQATGGGVLGDLWATEERGRALAFYSLALLLGPAVGPIAGGFVAETTSWRWIFYATTISNGVVMLLGFLLLQETRASPQLERKKRRRIRETGSKAWVTETHNADHRLKNIILTALNRPFDLLFTEPIVQVLAVYLAYQYGIVYLVLASFPDLWTSPDHYGESVGIGGLNYIALACGFLLGAYLCAPTQDRIYRRLKDRNGGVSRPEYRIPLMIPSAILVPVGLFIYGWTFEYRTFWIGPDIGIALYAAGYITSFQCVQVYIVDTYTNYAASALASVTVLRSLCAFTFPLFAPKMYDALGYGWGNSMLAFIAMGLGWPGPFVLWRYGQALRERPPYAAEI

SEQ ID NO: 97 - protein, 502 aa, Artificial Sequence
  sequence variant 3 of ORF 8_9399
MSAEAEKNSSSPADSSLQTIHDARSGPPDDAEAPELITSDSPNLPANPKNWSPRRPWAATMVVSGFNFIFPLAIAMIAPCLPALAAELDITSSVEQSMALSVFVLGYAVGPLVVGPLSELYGRVPVLQTSNLVSLLFNLAFGLAGTKGEMIAFRFIAGLGGSAPQATGGGVLGDLWATEERGRALAFYSLAALLGGAVGPIAGGFVAEHTSWRWIFYATTISNGVVMLLGFLLLQETRATVLLERKKAKRIREKGSKAWHTRTDDPWHTLRNIILHAHSRPFRLLFTQPIVQVLAVYLAYIYGIVYLVLASFPDLWTSPDHYGESVGIGGLNYIALACGFLLGAYLCAPTQDRIYRRRKDRNGGVGRPEYRIPLMIPSAILVPVGLFIYGWTAEYATFWIGPDIGIALYAAGNITSFQCRQVYIVDTYTNYAASALASVTVLRGLCAFTFPLFAPKMYDALGYGWGNSMLAFIAMGLGWPGPFVLWRYGQALRERSPYAAEI

SEQ ID NO: 98 - protein, 502 aa, Artificial Sequence
  sequence variant 4 of ORF 8_9399
MSAEAEKPSQSPPDSTLQTIVDDRDQPPGDAEGPELITWDGESDPFNPKTWSRRRAWAATMVVSGFNFISWLASTMIAPCLPALAAELDITPIVEQSMALSVFVLGYAVGPLVVGFLSELYGRVPVLQTSNLVGLLFNLATGLARTKGEMIAFRFIAGLGGSAPNATGMGVLGDLWATEERGRALAFYSLAPLLGPAVGPIAGGFVAENTSWRWIFYAPTISNGVVMLLGFLLLQETRGSVLTERRRRRRIRETGSKAWRTETDDPDRTLENTIETRILGPFRLLFTQPIVQVLAVYLAYIYGIVYLVLASFPILWNSLDHYGESVGIGGLNYIALACGDLLGAYLCAPTQDRIYRRLKDRNGGVGRPEYRIYLMIPSAILAPVGLFIYGWTAVAHTFWIGPDIGIALYAAGYITSFQCVQVYIVDTYTNYAASALASVIVLYLLCAFTFPLFAPKMYDALGYGYGNSMLAFIAMGLGWPGPFVLWRYGQATRERSPRAAEI

SEQ ID NO: 99 - protein, 502 aa, Artificial Sequence
  sequence variant 5 of ORF 8_9399
MSQTAEKQLSSPADSTLQTIHDERDQKPGDAESGGLITWDPPDDPALPKNWSRRYLWAATMVVSGFNFISPLASAMIAPCLPALAAELDITPSVEQSMALSVFVLGYAVGPLVVGPLSELYGRVPVLQTSNLVFLLFNLACGLARTKGEMIAFRFIAGLGDSAPQATGGGVLGDLWATEERGRALAFLSLAPLLGPAVGPIAGGFVAENTSWRWIFYAFTISNGVVMLLGFLLLQETRAWVVRKRKKRTIIRKQANGAWGFIETNLGHSSRNLIETALNSPFRTLFTIPIVQVLAVYLAYVYGIVYLVLASFPDLWTTPDHYGESVGIGGLNYIALACGFLLGAYLCAPTQDRIYRRLKRRNGGVGRPEYRIPLMIPSAILVPVGLFIYGWTAEYSTFWIGPDIGIALYAAGYITSFQCVFVYIVDTYTNYAASALASSTVLQSLCAFTFPLFAPKMYDALGYGWGNSMLAFIAMGLGWPGPFVLHRYGQALRERSPYAYEI

SEQ ID NO: 100 - protein, 234 aa, Artificial Sequence
  sequence variant 1 of ORF 9_9399
MSGHNKACLTLPVAVVDDYQAKGRYETVLDTTTYITGPSDARRALLLIYDAFGYSPQLLQGADILAASLNALVVVPDFFKGKVASTSWFPPDTEEKKAAIGERFATAGNFAVRIEPMDELVQQLSTQYPSVSGKWGAFGYCWGGKMVALTMLSADDVEKINIPHIILASKDEDATSVAECKKVLEGPGKTGLVKSYPDQDHGWMAARCNLKDETVRKAFEDGYKTAAEFFEQHL

SEQ ID NO: 101 - protein, 234 aa, Artificial Sequence
  sequence variant 2 of ORF 9_9399
MSGHNCACLCLPVAVVDDYQAKGREETVLDTKTYITGPSDASRALLLIYDAFGYSPQLLQGADILAASLNALVVVPDFFKGVVASEGWFPPDTMEKKAAIGDWFAPAGNFAVHLEPMKELVQQLSTQEPSCSGKWGAFGYCWGGKMVALTMVSADDVSKINIPHIILASKDEDATAVAECKKVLEGPGKTGLVKSYPDQLHGWMAARANIKDETVRKAFEDGYKTAAEFFEQHL

SEQ ID NO: 102 - protein, 234 aa, Artificial Sequence
  sequence variant 3 of ORF 9_9399
MSGHNKACLCVPVAVVDDYQAKGRYETVLDTDTYITKPSDASRALLLIYDAFGYSPFLLQGADILAANLNALVVVPDFFKGEGASESWFPPHTEEKKAAIGSWFATALNFAVHAEPMKELVQQLSTQYPSVSGKWGAFGYCWGGKMVALTMLSADDVPKINIPHIILASKDEDATAVAECKKVLEGPGKTGLVESYPDQIHGWMAARANLKDTTNRKAFEDGYATAAEFFEQNL

SEQ ID NO: 103 - protein, 234 aa, Artificial Sequence
  sequence variant 4 of ORF 9_9399
MSGHNGACLCTPVAVVDDYQAKGREETVLDTQTYITGPADASRALLLIYDAFGYNPQLLQGADILAAELNALVVVPDFFKGKVVSESWFPPDADEKKAAIGDKFALAANSAAHIEPMSELVQQLSEQYPSHSGKWGAFGYCWGGKMVALTMLSADDVSKINIPHIILASKDEDATLVAECKKVLAGPGKTGLVKMYPDQIHGWMAARANLKDSTDRKAFEDGYATAAEFFEQHL

SEQ ID NO: 104 - protein, 234 aa, Artificial Sequence
  sequence variant 5 of ORF 9_9399
MSGHNKACLCEPVALVDDYQAAGRYETVLDTATYITGPSDASRALLLIYDAFGYSPQLLQGADILAASLNALVVVPDFFGGDVAHESWFPPDTEEKTAQIAGWFATAGDFAVQQEPMKELVQQLSTQGPSVAGKWGAFGYCWGGKMVALTMLSADDVSAINIPHIILASKDEDATAVAECKKVLEGPGKTYLVHSYPDQEHGWMASRANSKDPTVRHAFEDGYKTAAEFFEQHL

SEQ ID NO: 105 - protein, 250 aa, Artificial Sequence
  sequence variant 6 of ORF 9_9399
MSGHNKACLCLPVAVVDDYQAKGRYETVLDTKTYITGPSDASRALLLIYDAFGYSPQLLQGADILAASLNALVVVPDFFKGKVASESWFPPDTEEKKAAIGDWFATAGNFAVHIEPMKELVQQLSTQYPSVSGKWGAFGYCWGGKMVALTSGEGTIFKTSGQTHPGMLSADDVSKINIPHIILASKDEDATAVAECKKVLEGPGKTGLVKSYPDQIHGWMAARANLKDETVRKAFEDGYKTAAEFFEQHL

SEQ ID NO: 106 - protein, 250 aa, Artificial Sequence
  sequence variant 7 of ORF 9_9399
MSGHNGACLCLPVAKVDDYQAKGRYETVLDTKTYITGPTDAKRALLLIYDAFGYSPQLLQGADILAASLNALVVVPDFFKGKVASESWFPPTTEEKRAAIPDWFQTAGNFAVHIEPMKELVQQLSTQYPSVSGKWGAFGYCWGGKMVALTSGEGTIFKTSGQTHPGMLSADDVSKINIPHIILASKDEDATAVAECKKVLQGPGKTGLVYSYPDQRHGWMAARANTKDETVRAAFEDGYKTAAEFFEQHL

SEQ ID NO: 107 - protein, 250 aa, Artificial Sequence
  sequence variant 8 of ORF 9_9399
MSGHNKACLCLPVAVVDDYQAKGRYETVLDTKTYITGPSDASRALLLIYDAFGYSPQLLQGADILAASLNALVVVPDFFKGKVYSESWFPADTEEPKAAIGDLFKTKANFAVHIEPMKELVQWLSGQYPGVSGKWGAFGYCWGGKMVALTSGEGTIFKTSGQTHPGMLSADDVSKINIPHIILASKDEDATAVEECKKVLEGPGKTGLVKSYPDQPHGWMACRANLKDETVRKAFEDGYKTAAEFFEQHL

SEQ ID NO: 108 - protein, 250 aa, Artificial Sequence
  sequence variant 9 of ORF 9_9399
MSGHNKACLCLPVAVVDDYQAKGRYETVLDTKTYITLPSGASRALLLIYDAFGYSPQLLQGADILAASRNALVVVPDFFNGKVKSESWIPPGSEEKKKAIGDLFDTAGNFAVHIEPMKELVQQLSTQYPSVSGKWGAFGYCWGGKMVALTSGEGTIFKTSGQTHPGGLSIDDVSKINIPHIILASKDEDATAVAECKKVLEGAGKTVLVKSYPDQPHGWMAARANLKDRTVRKAFEDGYNTAAEFFEQHL

SEQ ID NO: 109 - protein, 250 aa, Artificial Sequence
  sequence variant 10 of ORF 9_9399
MSGHNKACLCLPVAVVDDYQAKGRYETVLDTKTYITGPSDAARALLLIYDAFGYSPHLLQGADILAAELNALVVVPDFFGGKVSSISWYPPDTEEKKAAISDWFASAGNFAKHTEPMKELVQQLSTRYPSVSGKWGAFGYCWGGKMVALTSGEGTRFKTSGQTHPGMLSRDDVGKINIPHIILASKDEDATAVVECKKVLTGPGKTGLVKSYPDQPHGWMAARPNPKASTVRKAFEDGYDTAAAFFEQRL

SEQ ID NO: 110 - protein, 250 aa, Artificial Sequence
  sequence variant 11 of ORF 9_9399
MSGHNKACLCGPVAVVDDYQAPGRAETVLDTKTYITQPADARRALLLIYDAFGYSPQLLEGADILAASLNALVVVPDFFKGKVATEVWVPADTEEQVAAIGDWFAPAGNPAQVIEPMKELVQQLSNQYPSVSGKWGAFGYCWGGKMVALTSGPGAYFKTSGQTHPGMLSADDVSKINIPHIILASKDEDATAVAECKKVLEGPGKTGLVESYPDQIHGWMAARGNDKDPTVRKAFEDGYKTAAEFFEQHL

SEQ ID NO: 111 - protein, 513 aa, Artificial Sequence
  sequence variant 1 of ORF 10_9399
MPSASEELPLLGEDQMPKSSQIAIVPDFKPPQDELKAHSIFCRPQKILIVIIASLAAFFTPVSSAIYFPALGPLADALGVSVSLINLTVTTYLVMQGLAPSFIGSWSDRAGRRPLYIACFVIYIGSNIGLALQTNYVALLILRMVQSAGSSPLVSLAQAVVADMATSAERGRYISYVTSGAILGPAVGPLIGGMLIQSQGWRSVFWFLAIFAGVVFLLMLACLPETCRDVVGKGSKPPPTWIHMSWLQYRKRRQIPLNGPPMTESTIPAAIRPGRKASPTGPLRVIADRETSLILIYAGCVLAGYQMVSANLSEALSAGYAFNTFQVGLCFLPFGAGAFLATLTTGHIVDWNFRRLARIHHTDLRQGRQQDLSQFPREKARLLVGMPIVGVGALSVLVYGWTMSATTPLAVPLVALFVVGWTVSSSTNSISVLIVDLHLDTPATATAANNLVRCWMGALAVAVMGPAVEAIGIGTMGTVICAVYIGLLPMLMLVWGKGPTWRRMKRERWPMMT

SEQ ID NO: 112 - protein, 513 aa, Artificial Sequence
  sequence variant 2 of ORF 10_9399
MPSASEETPLLGEDQCPKSSQGVIVPVFKNPQDELKAHQIFTRPQKILIVIIASLAGFFSPVSSTIYFPALGTLADALGVSVTLINLTVTTYLVMQGLAPSFIGSWSDRAGRRPLYIACFVIYIGSNIGLALQTNYVALLILRMVQSAGSSPLVSLAEAVVADMATSAERGRYISYVTSGAILGPAVGPLIGGMLIQSFGWRSVFWFLAIFAGVVFLLMLACLPETCRAVVGDGSIPPPTWYHMSWMAYRHSRQNPLPGPPMTISTSPAAIRPQVKASPTGSLRVIADRETSLILIYAGCVLAGLQMVSANLSEALSADYAFNVFQVGLCFLPFGAGMFLATLTTGHIVDWNFRRLLRIHHLDLRQGRQQDLSQFPIEKARLYVGMPIVGVGALSVLVYGWTMQARTPLAVPLVALFVVGWTVSSSVNSISVLIVDLHLDTSATATAANNLVRTWMGALAVAVMGPAVEAIGIGWMGTVICAVYIGLLPMLMLVWRKGPTWRREKREKWPIMT

SEQ ID NO: 113 - protein, 513 aa, Artificial Sequence
  sequence variant 3 of ORF 10_9399
MPSASETTPLLGEVQCPKTKQAAIVPEFKPPQAERKAHSIFTRPQKILIVIIASLAAFFSSVSSAIYFPALGTLADALGVSVSLINLTVTTYLVMQGLAPSFIGSWSDRAGRRPLYIACFVIAIGSNIGIALQTNYVALLILRMVQSAGTSPLVSLAQAVVADHATSAERGRYISYVPSGAILGPAVGPLIGGMLIQSFGWRSVFWFLAIFAGVVFLLMLACLPEGCRAQVGDGSIDPPTWIHMSWAYYRHRRQIPLNGPPMSISTSKAALRPGRHASPTGSLRVIADRRTSLILIYAGCVLAGYQMVSANLSEALSAQYAFNTFQVGLCFLPFGAGAFLASLTTGVIVDWNFRRMAVIHHLDLRQGRQQDLSQFPLEKARLQVGMPIVGVGALSVLVYGWTMQFRTPLVVPLVALFVVGWTVSSSTNSISVLITDLHLDTQATATAANNLVRCWMGALAVAVMGWAVEALGIGWMGTVICAVYIGLLPMLMLVWYKGPRWRREKREKWPMMT

SEQ ID NO: 114 - protein, 513 aa, Artificial Sequence
  sequence variant 4 of ORF 10_9399
MPSASETTPLLGEDQCPKESQGAIRPDFTPPQTELTASSILTRPQKWFIVIIASLAAFFSPVSSAIYFPALGDLADALGVSTFLINLTVTTYLVMGGLAPSFIGRWSDRAGRRPLYIACFVIYIGSNIGLALQTNYVALLILRMVQSAGSSPLVSLAQAVVADMATSAERGAYISYVSSGSILGPAVGPLIGGMLIQTFGWRSVFWFLAIFAGVVFLLMLACLPESCYASLVDGSIPKPTLIHMSWLAYQDKSQIPANGPPMTISTSPTAIELDRKAPPTGSLRVIADRETSLILIYAGCDLAGYVMVSANLSEALSAQYAFNPFQVGLCFLPFGAGNFLATLTTGHIVDWNFRRYARIHHNDLRQGRQQDLSQFPIEKARLQVGMPIVGVGALSVLVYGWTLQTRTPMAVPLVALFVVGWTTSSSWNSLSVLIVDLHLDTPAFATAALNLVRAWMGALAVAVMGPAVEAIGIGWMGTVICAVYIGLLPMLMLVVRKSPTWRREKREKWPMMT

SEQ ID NO: 115 - protein, 513 aa, Artificial Sequence
  sequence variant 5 of ORF 10_9399
MPSLIETAPLLGQLQCPGSEQAAIVLDFEPPQDELNAASITTEPQKILIVIIASLAAFFLPVSSAIYFPALGSLADALGVSVSTINLTVTTYLVMQGLAPSFIGSWSDRAGRRPLYIACFVIYIGSNIGLALQTNYVALLILRMVQSAGYSPLVSLAAAVVADMATSAERGRYISYVTSGAILGPAVGPLIGGMLIQSFGWRSVFWFLAIFAGVVFLLMLACLPETCKAVYRDGSIPKPTWIHASWAAYRARSSGPLNGPPSTISTSPAAERPRRKASPTKSLRVIADRETSLILIYQGCVQAGYQMVSANLSEALSQQYAFNPAQVGLCFLPFGAGAFLATLTTGHIVDWNFRRLQRIHHLDLRQGRQQDLSQFPTEKARLPVGMPIVGVSALSVLVYGWTMQARAPLVVPLVALFVVGWTVSSSTNSIAVLIVDLHLDTRATATAANLLVRRWMGALAVAVMGPAVEAIGIGPMGTVICAVYIGLLPMLMLVWRKGPTWRRKHRAKWPMMT

SEQ ID NO: 116 - protein, 596 aa, Artificial Sequence
  sequence variant 1 of ORF 11_9399
MNLVSLFLTVAFIPSALAQSYYPPLPAGTTVVNSKQYPNASIEYKETTICETTPGVKGYSGYVRLPSDAVNSVNGPSTSNYFFWFFEARHDPDKAPLAIYLDGGPGLSSLQGAFTETGPCYVNEDSNQTRLNPWSWNNHVNMLYIDQPLSTGFSYDILVNGTFDSLRDKQPATEHSINPLADEDEPVANNTYFVGTFSGQNPSNTANSTDNGAVGIWTFLQTWLNEYACLRGFPEYRLKDDRISLWGEATSAASLTVMHINMKFAGQFATIYAEEFLVQNEGITNGSLRRDSNSAESPRIIPVDTVGLINGWIDMFRQAAGYLTLPFSNTYGLQVANASVQRQITDAYDRDGGCKDLTQICETIAMESDPKNLAHNATTNEACFQSAYLCTTTVRGPIAATQRLVKALHKAHRPVAFLKSGAFALPWALQDLGKLLDSGVQVTMMYGDRDMDVSWIGGEEVSLAIDHSSAAEFAASGYESISVNAGYIGGVTRQYGRLSFSRVFEAANRVPSYQPETAYQIFMRAIFGKDIATGSTVVDARYASAGPSSSGHIRNGLPVAPPPECYIWAPATCTPAQLKSLGDGSAVVRDYIVVEW

SEQ ID NO: 117 - protein, 596 aa, Artificial Sequence
  sequence variant 2 of ORF 11_9399
MNLVSLFLTVAFIPSALAQSYYPPVPAGTTVVNSTQYPNASIEYKETTICETTPGVKGYSGYVRLPSDVVNSVNGPHTSNYFFWFFEARHDPDKAPLAIYLDGGPGLSSLQGAFEETGPCYVVEDSNTTRLNPWSWNNHVNMLYIDQPLSTGFSYDILSNGTFDSLRDKQPATEHSLFILADEDEPVANNTYFVGTFSGQNPGETANSTADGAVGIWTFLQTWLSEYACLRGFPEYRTKDDRISLWGEATSAASLTVMHINMKFAGQFATIYAEFFEVQNERIRNGSLRRDSNSPSSPRIIPVDTVGLINGWIDMFRQYAGYLTLPFNNTYGHQVANASVQRQITDAYDRPGGCVDQTQKCQHAAAESDPKNRAHNATVIEYCAKSAYLCDTTVRGLIAATQYLSKALHKAHRPVAFLKSGASALPWFLGDLGQLLDRGVQVTMMYGDRDMDVSWIGGEEVSLAIDHSSAAEFAASGYKSISVNAGYIGGTTRQYGRLSFSRVFEAANRVPSYQPPTAYKIFMRAIFGKDIATGSTVVDARYASTGPSSSGHIRNGLPVMPPPECYIWAPATCTPAQLKSLGDGSAVVRDYIVVEW

SEQ ID NO: 118 - protein, 596 aa, Artificial Sequence
  sequence variant 3 of ORF 11_9399
MNLVSLFLTVAFIPSALAQSYYPPVPAGTTVVNSTQYPNASIEYKETTICETTPDVKGYSGYVRLPSDAVNSVNGSHTSNYFFWFFEARKDPDKAPLAIYLDGGPGLSSLQGAFTETGPCYVNKDSNSTRLNPWSWNNHVNMLYIDQPLSTGFSYDIQTNTTVDSVRDKQPATEHSINPLADEDEPVANLTYHVGTFSGQNPGTTANSTANGAVGIWTFLQNWLSEYACLRGFPEYRTKDDRISLWGEATSAASLTVMHINMKFAGQFATIYAEEFEVANERIRNGSLRRDSNSPESAAIIPVDTVGLINGWIDMFRQYAGYLTLPFNNTYGLQVANASVQNQITDAYYEPGSCVDHTQKCQTAFQESDPKNRAHNADVDDLCFQSAYGCTTTVRGIIAATQRLSFALHKAHRPVAFLKSGAWALPWWLPDLGELLDRGVQVTMMYGDRDMDVSWIGGEEVSLAIDHSSVAGFRASGYESIYVNAGYIGGVTRSYGRLSFSRVFEAANRVPSYQPEAAYQIFMRAIFGKDIATGSTVVDARYASTGPSSSGHIRNGLPVAPPPECYIWAPATCTPAQLKSLRDGSAVVRDYIVVEW

SEQ ID NO: 119 - protein, 596 aa, Artificial Sequence
  sequence variant 4 of ORF 11_9399
MNLVSLFLTVAFIPSALAQSYYPPVPAGTTVVNSTAYPNYSIEYKETTICETTPGVKGYSGYVRLPSDVVNSVNGPYTSNYFFWFFEARADPAKAPLAIYLDGGPGLSSLQGAFTETGPCQVNEDSNVTRLNPWSWNNHVNMLYIDQPLSTGFSYDNNANTTHDSLKDVQPATEHSFDPLADEDEPVANNTYFVGTFSGQNPEETANSTANGAQGIWTFLQGWLARYACLRGFPEYSPKDDRISLWGEATSAASLTVMHINMKFAGQFATIYAAYFEVQNKAIGNGVLRRDSNSSNSPRIIPVDTVGLINGWIDMFRQYLGYPTLPYNNTYSLQVANASVQRQITDAYEREGGCVDSTDKCQDAAAESFPKNRAMIATVNENCFQSAFYCTTTFFGPIAATQRLSKALHKAHRPVAFLKSGAYVFPWALSDLGKLLDRGVQVTMMYGDRDMDVSWIGGELVSLAIDHTSAAEFAASGRASISVNAGYIGGVTRGYGRLSFSRVFEAANRVPSYQPQAAYQIFMRAIFGKDIATGNTVVDARYASTGPSSSGHIRNGLPVAPPPECYIWAPATCTPAQLKSLGDGSAVVRDYIVVEW

SEQ ID NO: 120 - protein, 596 aa, Artificial Sequence
  sequence variant 5 of ORF 11_9399
MNLVSLFLTVAFIPSALAQSYYPPVPAGTTVVNSTTYPNASIEYKETTICETTPGVKGYSGYVRLPSDVVNSVNGHHTSNYFFWFFEARHDPKKAPLAIYLDGGPGLSSLTGAFTETGPCYVNEDSNLTRLNPWSWNNHVNMLYIDQPLSTGFSYDILVNGTFDSLRDLQPATEHSINCLADEDEPVANFTYLVGTFSGQNTGQTANSTANGAVGIWTFLQGWLSEYACLRGFPEYRTKDDRISLWGEATSAASLTVMHINMKFAGQFATSYAQYFEVQNKRIRNGGQRRDSNSKESPRIIPVDTVGLINGWIDMTRQLAGYSTLPFNNTYGLQVANASVQRDITKAYQRPGVCVDQTQSCQTAMAESFFEIRAHWVTYKLACFQSALLCYTTVRGPIAYTQILSKALHKATRPRAFKKSGAGAAPWMIRDLAKLLDAGVQVTMMYGDRDMDVSWIGGEQVSLAIDHSSVNVFAKSGIESISVNAGYIGGFTRQYGRLSFSRVFEAANRVPSYQPETAYQIFNRAIFGKDIATGSTVVDARYASAGPSSSGHIRNGLPVAPPPECYIWAPATCTPAQLKSLGDGSAVVRDYIVVEW

SEQ ID NO: 121 - protein, 610 aa, Artificial Sequence
  sequence variant 6 of ORF 11_9399
MNLVSLFLTVAFIPSALAQSYYPPVPAGTTVVNSTQYPNASIEYKETTICETTPGVKGYSGYVRLPSDVVNSVNGPHTSNYFFWFFEARHDPDKAPLAIYLDGGPGLSSLQGAFTETGPCYVNEDSNSTRLNPWSWNNHVNMLYIDQPLSTGFSYDILVNGTFDSLRDKQPATEHSINPLADEDEPVANNTYFVGTFSGQNPGETANSTANGAVGIWTFLQTWLSEFPEYRTKDDRISLWGEAFAGQFATIYAEYFEVQNERIRNGSLRRDSNSPESPRIIPVDTVGLINGWIDMFRQAAGYLTLPFNNTYGLQVANASVQRQITDAYYRPGGCVDQTQKCQTAAAESDPKNRAHNATVNELCFQSAYLCTTTVRGPIAATQYNTFDMGHWNPDPFPPSYYIGYLNQRWVQEALGVPLNFTAHSSLVTMSFLKSGAFALPWALQDLGKLLDRGVQVTMMYGDRDMDVSWIGGEEVSLAIDHSSAAEFAASGYESISVNAGYIGGVTRQYGRLSFSRVFEAANRVPSYQPETAYQIFMRAIFGKDIATGSTVVDARYASTGPSSSGHIRNGLPVAPPPECYIWAPATCTPAQLKSLGDGSAVVRDYIVVEW

SEQ ID NO: 122 - protein, 610 aa, Artificial Sequence
  sequence variant 7 of ORF 11_9399
MNLVSLFLTVAFIPSALAQSYYPPVPAGTTVVNSTQYPNASIEYKETTICETTPGVKGYSGYVRLPSDVVNSVNGPHTSNYFFWFFEARSDPDKAPLAIYLDGGPGLSSLQGAFTETGPCRVNEDSNSTRLNPWSWNNHVNMLYIDQPLSTGFSYDILVNGTFDSLRDKQPATEHSIIPLADADEPNANVTYFVGTFSGQNPGETANSTANGAVGIWAFLQTWLSEFPEYRTKDDRISLWGEAFAGQFATYYAEKFEVQNERIRNGSLRRDSNSLESPRIIPVDTVGLINGWIDMFRQAAGYLTLPFNNTYGLQVANASVQREITDAYYRPGGCEDQTDVCEAAAAESDPKNAAHNATVNELCFQSAYFCTTTVRSPIMATQYNTFDMGHWNVYPFPPSYYITYLNQRWVQEALGVPLNFQAHSSLVTMSFLKSGAFALPWALQDLGELLDEGVQVTMMYGDRDMDVSWIGGEAVSLAIDHSSQAEFAASGYISISVNAGYIGGVTRQYGRLSFSRVFEAANRVPSYQPETAYQIFMRAIFGKDIATGSTVVDARYASVGPSSSGHIRNGLPVAPPPECYIWAPATCTPAQLKSLRDGSAVVRDYIVVEW

SEQ ID NO: 123 - protein, 610 aa, Artificial Sequence
  sequence variant 8 of ORF 11_9399
MNLVSLFLTVAFIPSALAQSYYPPVPAGTTVVNSDQYPNASIEYKETTICETTPGVKGYSGYVRLPSDVVNSVNGPHTSNYFFWFFEARQDPTKAPLAIYLDGGPGLSSLQGAFTETGPCYVNEDSNSTRLNPWSWNNHVNMLYIDQPLSTGFSYDILVNGTFDSLRQTQPATEHSIYPLADEDEPVANTTYFVGTFSGQNPGETANSTAAGAVGIWTFLQKWLSEFPEYRTKDDRISLWGEAFAGQFATIYAEHFLVQNERIRNGSLRRDSNSPPSPRAIPVDTVGLINGWIDMFRQASGYLTLPFNNTYGLQVANASVQEQISDGYYRPGGCVDQTQKCQTAAAESDPKNRAFDAMVNELCFQSAYLCSTTVRGPIAATQYNTFDMGHDNPDPFDPSYYIGYLNQREVQEALGVPYNFTAHSGLVTMSFLKAGAFALPWALQDLGKLLDRGVQVTMMYGDKDMDVSWIGGEEVSLAIDHSSASEFADSGYESISVDAGYIGGVTRQYGRLSFSRVFEAANRVPSYQPETAYQIFMRAIFGKDIATGSTVVDARYASTGPSSSGHIRNGLPVAPPPECYIWAPATCTPAQLKSLGDGSAVVRDYIVVEW

SEQ ID NO: 124 - protein, 610 aa, Artificial Sequence
  sequence variant 9 of ORF 11_9399
MNLVSLFLTVAFIPSALAQSYYPPVPAGTTVVNSTQYPNASIEYKETTICETTPGVKGYSGYVRLPSDKVSSVNGPHTSNYFFWFFEARHDPDKAPLAIYLDGGPGLSSLQGAFTETGPCHVNEDSNTTRRNPWSWNNHVNMLYIDQPLSTGFSYDILVNGTFDSLRSKQPATEHEITPLADEDEPVANNTYFVGTFSGQNPGETANSTANGADGIWTFLQTWLSEFPEYRTKDDRISLWGEAFAGQFATIYAEYFEVYNNRIRNGSLARDSNSPESPRPIPVDTVGLINGWIDMFRQAAGYLTLPANNTYGLQVANASVQREITDAYFEPGGCVEQTDKCQKAVAESDPKNRAMNATVNELCAQSAYLCTTTVRGPIAVTDYNTFDMGKANPDPFPPSYIIGYLNQRWVQEALGVPKNFSAHSDGVTSSFLQSGAWALPWALQALPKLLDRGVQVTMMYGDRDMDVSWIGGEEVSLAIDHSSAAEFRASGYESISVNAGYIGGVTRQYGRLSFSRVFEAANRVPMYQPEVAYQIFDRAIQGKDIATGSTVVDARYASDGPSSSGHIRNGLPVAPPPECYIWAPATCTPAQLKSLGDGSAVVRDYIVVEW

SEQ ID NO: 125 - protein, 610 aa, Artificial Sequence
  sequence variant 10 of ORF 11_9399
MNLVSLFLTVAFIPSALAQSYYPPVPAGTTVVNSPQYPNASIEYKETTICETTPGVKGYSGYVRLPSDVVNSVNGPHTSNYFFWFFEARHDPDKAPLAIYLDGGPGLSSLMGAFQETGPCRVNEDSDSTRYNPWSWNNVVNMLYIDQPLSTGFSYDILSNGTFDSLRDKQPATEHSITPLADADEPDANNTYFVGTFSGQNPGETANSTANGARGIWTFLQTWLTRFPEYRTKDDRISLWGEAFAGQFATQYAQYFEVQNERIRNGSLRRDSNDPNSKRIIPVDTVGLINGWIDMFIQDAGYLTLPWRNTYGLQVANAAVQRQITEAYYKPGGCENQNKKCNTAWAESDPKVRAHNAAVNEPCFQSSHVCNSTVSGPITAKQYNMFDMGHWCPDPFDPEYYIGYLNQRWVQEALGVPHNFTWHSSDVTAKFLKSGANALPWMLQYLVKLLDRGVQVTMMYGDRDMDVSWIGGEEVSDAIDHSSAAEFAPSGYKSISVNAGYIGGVTRQYGRLSFSRVFEAANRVPSYQPETAYQIFMRAIFGKDIATGKTVVDARYASAGPSSSGHIRNGLPVAPPPECYIWAPATCTPAQLKSLGDGSAVVRDYIVVEW

SEQ ID NO: 126 - protein, 610 aa, Artificial Sequence
  sequence variant 11 of ORF 11_9399
MNLVSLFLTVAFIPSALAQSYYPPPPAGTTVVRSTFYPNLSIEYKETTICETTPGVKGYSGYVRLFSDVVNSVNGGHTSNYFFWFFEARHDPDKAPLAIYLDGGPGLSSLQGAFTETGPCYVNQDSKSTIENPWSWNNFVNMLYIDQPLSTGFSYDILVNGTSDSSRSKQPATEHSINALADYDEPEANETYFVGTFSGQNVGETANSTAGGATGIWDFLQTWLSIFPEYRTKDDRISLWGEAFAGQFATIYAEYFEVDNERIRNGSLTRDSNSAESPPIIPVDTVGLINGWIDMFRQANGYLTLPFTNTYGHQVANAHVQRQIKDAYYLPGGCQDQTQKCQTAARESDPKMRAHMASVNDLCFQSAYACTTTVRSPIAATQYNTFDMGTWGPEPFPPDYYIGYLNQRWVQEALGVPLNFVAHSSPVTMNFLNSGAFALPWALQDLGKLLDTGVQVTMMYGDKDMDVSWIGGEFVSFAIDHSSAKEFEASGYESIYDNAGYIGGVTRQYGRLSFSRVFEAANRVPSYQPETAYEIFERAIMGKDIATGSTVVFARYASTGPSSSGHIRNGLPVAPPPECYIWAPATCTPAQLKSLGDGSAVVRDYIVVEW

SEQ ID NO: 127 - protein, 490 aa, Artificial Sequence
  sequence variant 1 of ORF 12_9399
MPSSSFPHPPSPGETASKPGEPVKLRSTCDACQKAKHRCSREQPCQHCKYNKVPCVYSALRRIGRPPRRKHPGDAAEREKTPKRSKNRAFQGNNTASTHASEGSPAEPPLPPTTASISISHNAVDSFSSSSSYDHAFLLGHGPAAAARQDDDAWLEMDGSNHDPAGDPSGPPAFDLESILDFDGPTLSGITAGASMAPSDQGPCPPGTEPPSFLESFKSAAAPMGDKFLFLENPPPFESSAGPGLPPSAPEEPGVGYPMSMPIDSHPEGSAPRPQRLPSAPEARHCECYQTVLKSLGDFDRRTSLGLACSIDMLVLLEQSAVRQAAQVLQCQGCMESRVDLLLLVALKIDNTVGMLEWVSKFNLTLIRPGAMSSTLAGSRRSSCGACDSASVSSLGSSQGSRASGNSLSGLMNSRRLLAGAFEIQAQEKIHFFKSFLCKRLRRLSNVLQQLQQRMLQAPQTSISQTGFNLVRENDRRLQSVIGRLELWQG

SEQ ID NO: 128 - protein, 490 aa, Artificial Sequence
  sequence variant 2 of ORF 12_9399
MPSSSFPHPPSPGETASKPGEPVKLRRTCDACQKAKHRCSREQPCQHCKYNKVPCVYSALRRIGRPPRRKPPGDAAEREKTPKRSKNRAFQGNTTASTHASEGSPAEPPLPPTTASISASHGTVDSFSSSSSYDHAFLLGHGPAAAARMDDDAWLEMDGSNHDPAGDPSGPPAFDLESILDFDGPTLSGMTAGASMAPSDQTPCPPGTEPPSFLESIKSAAAPMGDAFLFLENPPPFESSAGPGLPPPAPEEPGVGYPMSMPADSSPELSAPRPQELPSAPPARHCECYQSVLASLFDFDRRTSLGLACSIDMLVASEQSAHRGADQVLQCQGCASSRPDLLLLVVLKIDNTVGMLESVSKKNLTLIRSGAASSLLAGSHRSSCGACDSASVSSGGSSQGSRASNNSLSGLMNSRRLSAGAFEIQAEDKIFFFKQFLHKRLRRLSSVLQQLQQRMAQAPQTSISQTGFNLVSENRRRLQSVIGRLELWQG

SEQ ID NO: 129 - protein, 490 aa, Artificial Sequence
  sequence variant 3 of ORF 12_9399
MPSSSFPHPPSPGETASKPGEPVKLRTTCDACQKAKHRCSREQPCQHCKYNKVPCVYSALRRIGRPPRRKPPGDAAEREKTPKISKNRAFQGNNTASTHASEGSPAEPPLTPTTASISISHRAVDSFSSSSSYDHAFLLGHGPAAAARMDDDAWLEMDGSNHDPAGDPSGPPAFDLESILDFDGPTLSGMTAGASSQPSDQGPCPPGTEPPSTLESFKRAAAPMGDAFLFLENPPPFESSAGPGLPPPAPEEPGVGYPMSMPSDSAPENSAPRPQTLPSAPPARPCECYQSVLAELGDFDTRTSLGLAPSIDMLVALEQNAHRQCAQVLQCKGCSGSRPSALLLVALKIDNTVTMLEWVSKFELTLIRPGASSSCLSGSFRSSCGACDSASLSSGGQSQGSRPSNNSLSGLMCSRRLLAGAFEIQAEEKIHFLKQFLCRRLRRLSSVLQQLQQRMLQTPQTSISQTGFNLVEENRRRLQSVIGRLELWQG

SEQ ID NO: 130 - protein, 490 aa, Artificial Sequence
  sequence variant 4 of ORF 12_9399
MPSSSFPHPPSPGETASKPGEPVKLRSTCDACQKAKHRCSREQPCRHCKYNKVPCVYSALRRIGRPPRRKPSLDAAEREKTPKRSKNRAFQGNATASTHASEGSPAEPPLGPTTASISISHDAVDLFSSSSSYDHAFLLGHGPAAAARPDDDAWLEMDGSNHKPAGDPSGPPAFDLESILDFDGPTLSGYTAGISMALSDQGPCPPGTEPPSFLESMKSMAATMGDAFGFLENPPPFESSAGPGLPPPAPEEPGVGYPMSMPADSHPEGSAPRPQELPSAARKRPCGCYQSVLASLGFFDRRTSLGLACSIDQLVALEQQAHQIVAVVLQCQTCRISFPDSLLLVALKIDNTVEMLESVSKFNLTLIRPGATSSLLAGSRRSSCGACDSASVSSGGSSQGLRASNNSPSGLMNTRRLRAGAFEIQAEEKIYFFKRFLLKRLRRLSVVLDQLQHRMTQAPQTSISQTGRNLVSENDRRLQSVIGRLELWQG

SEQ ID NO: 131 - protein, 490 aa, Artificial Sequence
  sequence variant 5 of ORF 12_9399
MPSSSFPHPPSPGETASKPGEPVKLRSTCDACQKAKHRCSREQPCQHCKYNKVPCVYSALRRIGRPPRTKRPGDAAEREKTPKISKNRAFQGNNTASTHASEGSPAEPPLQPTTASISIIHRAVDLFSSSSSYDHAFTLGHGPAAAAVMDDDPWLEMDGSNHDPAGDPSGPPAFDLESILDFDGPTLSGMTAGASMAPSDQGSCPPGTEPPSFLESFKSDSAPLGDAFLFLENPPPFESSAGPGLPPPAPEEPGVGYPMSMPADSHPELSADRPQRTPVAPPARHCECYDSVLASLGEFDQRTSLYLACSIDALVAVEQSAHHLAAQVLQCPGCMGRRPDLLLLVSLSIDNTVGMLESVSNFNLTLIRPGANSSDLAGSRRSSCGACDSASVSSLGSSQGSRASNNSLRAYMNSRRLYAGAFEIAVGEKIHFFKQFLAKRLRRLSSVLQQLIQCMGQRPGTSISQTGFNLVEENDRRLQSVIGRLELWQG

SEQ ID NO: 132 - protein, 376 aa, Artificial Sequence
  sequence variant 1 of ORF 13_9399
MHFNLLLVLTVLLRQATALVLPPSNSTSNSTPKFSARTVFQFPQGYWLENLAVRGNGQVLATTYMNSAGLYLIDPTQNAPYGATLVHQFENSPSALGIVEAEGYEPDTFYLATLNFSAADGFPPRTFQVWRVDMSSFHVSPQTGQVSGKAAVSLVTTLSSVGMANGMTLLAPDSSHILIADSLRGAIWDLDTATGHYGLSSSFPAMPSDNPARRFLGIDGVKVHQGSLYFNNAGEFTLARMPIHSDGVAKGEFVVLATDLYSDGFCLYDADTVLVTMNRDNGLAALDLDSHRGWMVAGNMPDGVFRTPTSVELGRGEDAGKLAYVTMGGTYVATGAEDLVGGSLVVVDLKSATTDPKGTGRGGLLVQETETIWLEL

SEQ ID NO: 133 - protein, 376 aa, Artificial Sequence
  sequence variant 2 of ORF 13_9399
MHFNLLLVLTVLLRQATALVLPPSNSTSNSPPKFSARTVFQFPQGYWLENLAVRGNGQVLATTYMPTAGLYLIDPRQHASVPAELVHQFEEATSALGIVEAEGTEPDTFYLATLNFSAADGFTPRTSIVWRVDMSSFVYSPQTGQVSGPASVSHVTTLSSVGMANGMTLLAPDCSHILIADSLRGAIWDLDTATGHYGLSSSFPAMRSDNPARRFLGIDGVKVRQGSLYFNNAGEFTLARMPIHSDGIAKGEPVVLATDLYSDGFCLYDADTVLVTMNIDNGLAALDLESHRRAMVAGNMPDGVFTTPTSVELGRGEDAGKLAYVTMGGTYAATGAEDLVGGSLVVVDLKSATTDPKGTGRGGLLVQETETIWLEL

SEQ ID NO: 134 - protein, 376 aa, Artificial Sequence
  sequence variant 3 of ORF 13_9399
MHFNLLLVLTVLLRQATALVLPPSNSTSNSTGKFKARTVFQFPQGYWLENLAVRGNGQVLATTYVNSAGLYLIDPKPPASYPAVLVHQFENSTSALGIVEAEGTEPDTFYLITLNFSASDGFVPRTSAVWRVDMSSFHYSPQTGQVAGKATVSHVTTLSGVGMANGMTLLAPDSSHILIADSLAGAIWDLDTVTGEYGLSSSFPAMRSDNPPRRFLGIDGVKVSQGSLYFNNAGEFTLARMPIHPDGKAKGEPVVLAYDLYWDGFCLYDPDTVLVTMNRDNELAALDLESHRRWMVAGNMDDGVFTTPTSVELGRGSDAHKLAYVTMGGMYVATGAEDLVGGSLVVVDLKSATTDPKGTGRGGLLVQETETIWLEL

SEQ ID NO: 135 - protein, 376 aa, Artificial Sequence
  sequence variant 4 of ORF 13_9399
MHFNLLLVLTVLLRQATALVLPPSLSTSSSLGKFSARTVFQFPNGYWLENLAVRGNGAVLATTYMPIAGLYEIDPVPPASYPAVLVHQFEGSTSALGIVEAEGTEPDTFYLATLNFSAADGFLPRTSQVWRVDMSSTEYSPQTGQVSGKAAVEQVTTLSSVLMANGMTLLAKDEDHILIADSLRGLIWDLDTATGKYGLSSSAPAMASDNPARRFLGIDGVKVQQGSLYFNNAGERTLGRMPIHEDGEAKGEPVVLATDVYSDGFCLYDADTALVTMNIDNSLAALSLESHRRWMVAGNPVDSVFTTPTSVELGRGEKAYKLAYVTMGGTYVATGAEVLVGGSLVVVDLKSATTDPKGTGRGGLLVQETETIWLEL

SEQ ID NO: 136 - protein, 376 aa, Artificial Sequence
  sequence variant 5 of ORF 13_9399
MHFNLLLVLTVLLRQATALVLPPSNSTSNSLGKFAARTVFQFPQGYWLENLAVRGNGGVLATTLMETAGLYLIDPTPNTSYPAELVHQFEESSSALGIVEAEGTEPDTFYLATLNFSAPDGFVPRTAFVWRVDMPSFRISPQTGQVVGTADVTHVTTLSGVGMANGMTLLAPDSSHILIADSLLGAIWDLDTLTGHYGLSSSFPLMRSSNPARRFLGIDGVKVHQGSLYFNNADEFTLCRMPIHEKGIAKGEPVVLASDKTSDGFCLYDADTVLVTMNIDNGLAFLDLESHRIWMVAGNMPDGVFTTPTSVELGRGHDAGRLAYVTMGGVYVATGAELLVGGSLVVVDLKSATTDPKGTGRGGLLVQETETIWLEL

SEQ ID NO: 137 - protein, 446 aa, Artificial Sequence
  sequence variant 1 of ORF 14_9399
MSAGALHIRDSRTSREYEIPIRNNTVLATDLKQIKASPVGADRADKVGDGLRVLDPGLKNTCVVETNMTFTDGHRGLLLFRGYALEQLWQPEFEDMLHLLVWGKYPTPSQREALRLRLATFMSTTPKHVAEDIERFPQTSPPMPMIVAGLSAYLAHHADSIPACAGGNIYIGNPEQTDRAILRTAAAYAVVMGMAASHRRGIAFTPATTDNTYFENLFIMMGLVEQRTGRPDPVALSCFRRFAALNSEHGMALSSFAMVVTASSLTDPISGLISSLVAAYGPLHFGAPEAEYKTIQAVGSVDQVPAFLEEVKSGKRRLFGYGHRTYTEIDPRVKPIKDMLFRELDDDQDPLVKVAREIDRLSSTDEYFIKRKLAANADFYGTFFFKRLGFQFEEIPVAMVAQRLVGILAHYRESMLKLKGRLFRPTHVYTGETEPVLEMTAPSAKL

SEQ ID NO: 138 - protein, 446 aa, Artificial Sequence
  sequence variant 2 of ORF 14_9399
MSHGALHIRDSRPSREYEIPIRRNTVLAVDLKQIKASPVGADRADKVGDGLRVFDPGLKNTCVVVTNMTYTDGHRGLLLFRGYALEQLWQAEFEDMLHLLVWGKYPTPSQREALRLTLKTFMSTTPKFVAEVIETFPPTSPPMPMIVAGLSAYLAHHADSIPYCAGGNIFHTNPEQTTRAILRTAAAYAVVMGMAASHRRGIPFTPATTDNTYFENLFIMMGLVEPRTGRPDPVKLSCFRLFAALNSEHGMALSSFAMVVTASSLTDPISGLISSLVAAYGPLHFGAPEAEYATIEAVGSVDQVPSFLEEVKSGKRRLFGYGHRTYTTIDPRVKPIKDMLFSELAGQSDPDVKVAREIDRLSSTDEYFIKRKLVANADFYGTFFFNRLGFQPEEIPVAMVAQRLVGILAHYRESMLKNKDRLFRPTHDYTGEGEPVLEMTAPSAKL

SEQ ID NO: 139 - protein, 446 aa, Artificial Sequence
  sequence variant 3 of ORF 14_9399
MSHGALHIRDSRTSAEYEIPIIRNTVLATDLKQIKASPVGADRADKVGDGLRVFDPGLSNTCVCETNMTYTDGHRGLLTFRGYALEQLWQPEFEDMLHLLVWGKYPTPSQRETLRRTLATLMSPTPKHVARVIELFPPTSPPMPMIVAGLSAYLGHHADAIIACAGGNIYDNNPEQTDRAILRTAAAYAVVMGMAASYRRGGPFVPADTDNTYFENLFIMMGLVEPYTGKPDPVKLSCFRRFAALNSEHGMALSSFAMVVTASSLTDPISGLISSLVAAYGPLHFGAPEAEYKTIQAVGSVDQVPAFLDEVKSGKRRLFGYGHRTYTVIDPRVKPIKDMLFIHLDADGDPLVKVARAIDRLSSTDEYFIKRKLHANADFYGTFFFNRLGFQPEEIPVAMVAQRLVGILAHYWESMLKLNIRLFRPTHVYTGETEPVLEMTAPSAKL

SEQ ID NO: 140 - protein, 446 aa, Artificial Sequence
  sequence variant 4 of ORF 14_9399
MSHGALHIIDSRTSQEYEIPIRENTVLATDLKQILASPLGEDRADQVGDGLRVNDPGLKNTCVTETNMTYTDGHRGLLLFRGYALEQLWQSEFEDMLHLLVNGKYPTPSQRESLRATLAVLMSTTPKDVAQVIEGFPPTSPPMPMIVAGLSAYLAHHADSIPACAGGNIYDPNPEYEDRAILRTAAAYAVVMGMAASHSRGIAFTAATTDNTYFENLFIMMGLVECYTYRPDPVKLSCFRMFAALNSEHGMALSSFAMVVTASSLTDPISGLISSLVAAYGPLHFGAPEAEYRTILAVGSPDQVPAFLKEHKSGKRRLFGYGHRTYTTIDPRVKPIKDMLLSELDRDSEPLVKVAREIDRLSPKDEYFKERKLHANADFYGTFFFNRLGFQGEEIPVAMVAQRLVGILAHYRESMLKANDRLFRPTHNYTGETEPPLEMPAPSAKL

SEQ ID NO: 141 - protein, 446 aa, Artificial Sequence
  sequence variant 5 of ORF 14_9399
MSHGALHIRDSRTSKEYEIPIDRNTVGATDLKQIKASEVGADRADNVGDGLRVFDPGLENTCVVSTNMTTTDGHRGDLLFRGYALEQLWQAEFEDMLHLLVWGKYPTPSQREALRLTLATLMSTTPKHVAEVIETFPPTSPPMPMIVAGLSAYLSHHADEIPDCRGGRIDVLNPEQNDHQILRTAAAYAVVMGAAASFRRGLAFTPADTDNTYFENLFIMMGGVEVYTNRPDPVKLSCFRRFAALNSEHGMALSSFAMVVTASSLTDPISGLISSLVAAYGPLHFGAPEAEYKTIHAVGSADQVPAFLREVKSGKRRLFGYGHRTYTAIDPRVKPIKDMLMSELEKQSNPLVKVAREIDRLSSSDEYFGKRKLCANADFYGTFFFNMLGFQPEEIPVAMVAQRLVGILAHYLESMLAPRIRLFRPTHVYTGETEPYLEMTAPSAKL

SEQ ID NO: 142 - protein, 388 aa, Artificial Sequence
  sequence variant 6 of ORF 14_9399
MSHGALHIRDSRTSREYEIPIRRNTVLATDLKQIKASPVGADRADKVGDGLRVFDPGLKNTCVVETNMTYTDGHRGLLLFRGYALEQLWQAEFEDMLHLLVWGKYPTPSQREALRLTLATLMSTTPKHVAEVIETFPPTSPPMPMIVAGLSAYLAHHADSIPACAGGNIYHGNPEQTDRAILRTAAAYAVVMGMAASHRRGIAFTPATTDNTYFENLFIMMGLVEPYTGRPDPVKLSCFRRFAALNSEHGMALSSFAMVVTASSLTDPISGLISSLVAAYGPLHFGAPEAEYKTIQAVGSVDQVPAFLEEVKSGKRRLFGYGHRTYTTIDPRVKPIKDMLFSELDGDSDPLVKVAREIDRLSSTDEYFIKRKLHANADFYGTFFFNRL

SEQ ID NO: 143 - protein, 388 aa, Artificial Sequence
  sequence variant 7 of ORF 14_9399
MSKGALHIRDSRTSREYEIPIRRNTVLATDLKQIKAKTVGADRADNVGDGLRVFDPGLKNTCVVETNMTYTDGHRGLLLFRGYALEQLWQAEFEDMLHLLVWGKYPTPAQREALRLTLATLVSTTPKHVAEVIETFPRTSPPMPMIVAGLSAYLAFHADSIPACAGGNIYHGNPKQTDRSILRTAAAYAVVMGMAASHRRGIAFVPATTDNTYFENLFIMMGLVECYTGRPDPVYLSCFRQFAALNSEHGMALSSFAMVVTASSLTDPISGLISSLVAAYGPLHFGAPEAEYKTILAVGSPDQVPEFLEEVKSGKRRLFGYGHRTYTTIDPRVKPIKDFLDGELDGDSDPLVKVAREIDRLSSTDEYFIKRKLHANADFYGTFFFNRL

SEQ ID NO: 144 - protein, 388 aa, Artificial Sequence
  sequence variant 8 of ORF 14_9399
MSHGALHIVDSRTSREYEIPIRHNTVLATDLKQIKASPVGDDRADKVGDGLRVFDPGLKNTCVVETNMTDTDGHRGLLLFRGYALTQLWQAEFEDMLHLLVWGKYPTPSQREALRLTLATLMSETPKHVVHVIEGFPPTSPPMPMIVAGLSAYLAHHADSIPACAGGNIYHNNPEQLDRDILRTAAAYAVVMGMAASHRRGIAFTPATTDNTYFENLFIMMGFVEPYTYRPDPIKLSCFRRFAALNSEHGMALSSFAMVVTASSLTDPISGLISSLVAAYGPLHFGAPEAEYKTIQAVGSVDQVPAFLERVKSGKRRLFGYGHRTYTTIDPRVKPIKDMLFKELDGDTDKLVKVAREIDRLSSTDEYFVKRKLHANADFYGTFFFNRL

SEQ ID NO: 145 - protein, 388 aa, Artificial Sequence
  sequence variant 9 of ORF 14_9399
MSHGALHIKDSRTSREYEIPIRRNTVLATDLKQIKAQPLGADRADKVGDGLRVFDPGLKNTCVVETNMTYTDGHKGLLEFRGYALEQLWQAEFEDMLHLLVWGKYPTPAQREALALTLATLMSTTPKSVAEVIETFPPTSPPMPMIVAGLSAYLAQHADSQPACAGGNIYDGNPEQTDRSILRTAAAYAVVMGMAASKREGYDFTPAQSDNTYFENLFIMMGEVEPNTGRPDPVKLSCFRAFAALNSEHGMALSSFAMVVTASSLTDPISGLISSLVAAYGPLHFGAPEAEYKTIQAVGSVDGVPAFLAEVKSGKRRLFGYGHRTYTTIDPRVKPIKDMLFDELSGDSDPLVKVAKAIDRLSSTDEYFGKRKLHANADFYGTFFFNRL

SEQ ID NO: 146 - protein, 388 aa, Artificial Sequence
  sequence variant 10 of ORF 14_9399
MSHGALHIRDSRTSREYEIPIRTNTELATDLKQIKADPVGADRPDEVGDGLRVIDPGLKNTCVVETNMTYTDGERGLLLFRGYALEQLWQSEFEDMLHLLVWGKYPTPSQRDALRLTLANKMSATPDHVARTIKSFPRTSPPMPMIVAGLSAYLTFHADSIPTCKPQRIYHGNPAQTDKAILRTAAAYAVVMGMAASLRRGIAFTTATTDNTYFENLFIMMGAVEPYTGRPDPRELSCFRRFAALNSEHGMALSSFAMVVTASSLTDPISGLISSLVAAYGPLHFGAPEAEYKTIEAVGSVDEVPAFLEEVKSGKRRLFGYGHRTYTTYDPRVKPIKDMLFSELDGDSDPLVKVASEIDRLSSEDEYFAKRKLHANADFYGTFFFKRL

SEQ ID NO: 147 - protein, 388 aa, Artificial Sequence
  sequence variant 11 of ORF 14_9399
MSHGALHIIDSRTSREYEIPIRRNTVLATDLKQIKASPLGRDRRDKVGDGLRVKDPGLKNTAVVTTNMTYTDGHRGLLLFRGYALPQLWQAEFEDMLHLLVNGKYPTPSQRKHLDLKLATLMSTTPEAVAEVIEAFPPTSPPMPMIVAGLSAYLAAHADSVPACAGHNIYHGNIEQTLVAIIRTAAAYAVVMGMIASHFNGMAFTPATTDNTYFENLFIMMGLVEKYTERPDPVVLSCFRLFAALNSEHGMALSSFAMVVTASSLTDPISGLISSLVAAYGPLHFGAPEAEYKTIQAVGSVDQVPAFLENVKSGKRRLFGYGHRTYTTPDPRVKPIKDMLFKELDLDDDPLVKVARRIDRLSSADEYFIKRKLHANADFYGTFFFRRL

SEQ ID NO: 148 - protein, 345 aa, Artificial Sequence
  sequence variant 1 of ORF 15_9399
MASKETFSKYPAFPDNIPTAAVPKISLRQILSRDPTVSKRLVDAGKEFGCFKVDLTDAIDGPVLCQGVERGFDWGKAFFDQDAETKKAYKLSNQNVGYKQAGELVITAGRRDQVETCSVSRDDLLRSRPDLPSVFDQQRLLLQGLVAQLGQLSKLAVYHLSEGLGLDYGFVSARHDPRDQSATMIRFLHNPPTRGPRPELPSTEDPGSRAYLMGHSDGGTVTILFNVLGGLQLQRQQPDGSIEWQYIPPEPGCALIMVGDAFKSFTDGEVPSCVHRVIQPPGQQDRIDRYALGFFLGPANGASIGPVPRRGVTENGVNKASDYGQWAKNLNAALYNEMRQENVAI

SEQ ID NO: 149 - protein, 345 aa, Artificial Sequence
  sequence variant 2 of ORF 15_9399
MASKETFSKYPAFPDNIPEAAVPKISLRKILSRDPTVSKRLVDAGKEFGCFKVDLTDAIDGPVLCQGVERGFDLGKAFFDQDIETKKAYKLSKANVGYFQAGVLVITKDRRDQVETCFVSRDDLAASRPLLPSVFDQQRLLLQGLVAELGQLSHLAVYHLSEGLGLDYGVVSARHDPRDQSATMIRFLHNPPQRGPRQELQSTEDVGSRLYLMGHSDGGTVTILLNVLGGLQLQRQNPDGSIEWQAIPPEPGCALIMVGDAFKSFTDGEVPSCVHRVIQPPGEQDRFDRYALGFFSEPANGASIGPVPRRGVTENGVNKASDYGEWAKNKNAALYNEMRQENVAI

SEQ ID NO: 150 - protein, 345 aa, Artificial Sequence
  sequence variant 3 of ORF 15_9399
MASKETFSKYPAFPDNIPDAAVPKISLRQILSRDPTVSKRLVDAGKEDGCFKVDLTDAIDGPVLFQGVERGFDSGKAFFDQDIETKKAYRLVHDNVGYGQAGSLVITKEKRDQVETCHVSRDDEAATRPDLPSVFDQQRLLLQGLVAQLEQLSHLAVYHLSEGLGLDYGVVSKFHDPDDQSATRIRFLHNPPQRGPREELPSLEDPGSRAYLMGHSDGGTVTILFNVLGGLQLQRQQKDGSIKWQYIPPEPGCALIMVGDAFKSFTDGEVPSCLHRVIQPPGEQGRFDRYALGFFLKPSNGASIGPVPRRGLTENGVNKASDYGEWAKNKNAALYNEMRQENVAI

SEQ ID NO: 151 - protein, 345 aa, Artificial Sequence
  sequence variant 4 of ORF 15_9399
MASKETFSEYPAFPDNIPVAAVPKISLRQILTRDPTVSKRLVDAGKEFGCFKVDLTDAIDGSVLCQGVERGFDQGKAFFDQDVETKKAYRFSANNVGYKQEGTLQITKKRRDQVETCSVSRDDPNASRPDLPSVFDQQRLKLIGLVAQLGQLSLSAVYHLSEGLGLDYGVVSALHDLRDRSATLIRFLHNPPQRVPREELPSTEDPTSRAYLMGHSDGGTVTILLNVLGGLQLQRQSVDGSIEWQYIPPEPGCALIMVGDAFKSFTDGEVPSCVHRVICPPREQGGFDRYALGFFLKPANGASIGPVPRRGVTENGVNKASDYGNWAKGKNAALYNEMRQENVAI

SEQ ID NO: 152 - protein, 345 aa, Artificial Sequence
  sequence variant 5 of ORF 15_9399
MASKETFSKYPAFPDNVPDAAVPKISLRQIKSRDPTVSKRLTDAGKEVGCFKVDLTDAIDGPVLLQGVERGFDVGKAFFDQDIETKKAYKLSGFNVGYKQVGVLVITKEPRDQVETCYVSRDPLFSSRPDLPSYFDQQRLLLQGLVAQLGQLSQLAVYHLSEGLGLDYGVVSARHDPRDPSATMIRFLHNPPQRGPREELPSTPGKPSRVYLMGHSDVGTVTILFNVLGGLQLQRQQKDGSIEWQSIPPEPGCALIMVGDAFKSFTDGEVPSCVHRVIQPPGEQGRKDRYALGFFLKPASGAHIIPVPRRGVKENGVNKASDYGGQAKNKNAADYNEMRQENVAI

SEQ ID NO: 153 - protein, 531 aa, Artificial Sequence
  sequence variant 1 of ORF 16_9399
MGDHLITLDQIIQGSLRLCPGSMHSVMASSTKSPIPRVTVDEATAQLAPPQPPYSVFSPVQKKLIVFTAALASTFSPLSSNIYYPAINSIADELKISPGMVNLTITAYMVFQGLTPAFMGDLSDTAGRRPVYVLCFGIYIVANIGLALQRDFVALLVLRALQSTGISATFALSNAVAADTVTSAERGMYLGINSLGGILGSALGPTLGGLLSQSLGWRSIFWFLALVAAVFFVLLMLFFPETCRYRVENGSIPPPRWNRSLLACMVGRTEGKQQLNLSPEADSAPPKPHQKSRIRVINPWSTLRLLFEMPTGLVLLSNGIGYAAYYAVISTVPLQWNEIYHLNHSQLGLTYIPYGLGTILSAFTNGWLVDWNFQRITRQVGQLPIRNGKQDLRQFPIERARAQIAMPSAMLAAASIALYGWVIAAERPIVEALAMLLLIGYLVTASYNVMNVLIVDLHYGKPATATAANNLVRCLLGAGATAGVTPLLDMLGRQWCFCVVGAIYVISLPLSGLVGGFGAGPREKRDEETDG

SEQ ID NO: 154 - protein, 531 aa, Artificial Sequence
  sequence variant 2 of ORF 16_9399
MGDHLIFLDQIVQGSIRCCPGSAHSVMASSTKIPIPEVTVQEATADLAPPPPPYAQFSNVQAKLIVFTAALASTFTPLSSNIYYPAINSIEDELKISPGMVNLTITAYMVFQGLTPAFMGDLSDTAGRRPVYVLCFGIYIVANIGLALQSDFVTLLVLRALQSTGTSATVALSNAVAADTVTSAERGMYLGIASLGGILGLALGPTLGGLLSQSLGWRSIFWFLALVAAVFFVLLMLFFPETCRALVGNGSIPPPRWNLSLLDCMVGRTRGKQQSNLSPEIDNAPPKPHQKSRIRVENPWSTLRLLFEMPTGLVLLSNGISYAADYAVTSTVPTQWLEIYHLNDFQLGLTYIPIGLGTILSAFTNGWLVDWNFQRIARQVGQLPIRNGKQDLRQFPIERARLQIAMPSAMLAAASIALYGWVIAAERPIVEALAMLLLIGYLVTASYNVMNVLIVDLHYGKPATATAALNLVRCLLGAGATAGVTPLLDLLGRQWCFCVVGAIYVISLPLSGLVYGFGAGQRGKRDAERDG

SEQ ID NO: 155 - protein, 531 aa, Artificial Sequence
  sequence variant 3 of ORF 16_9399
MGDHLIFADQIVQGSLRLCPGSMHSVMGLSTKIPSPRVTVDEATQLLAPKEPPYTVFFPVQEWLIVFTAALAWTFSPLSSNIYYPAINSIANELKISPGMVNLTITAYMVFQGLTPAFMGDLSDTAGRRPVYVLCFGIYIVANIGGALQRDFVTLLVLRALQSTGISATVALSNAVAADLVTSAERGMYLGIASLGGILGPALGPTLGGLLSTDFGWRSIFWFVALVAAVFFVLLMLFFPETCRAIVGHGSIEPPRWRRSLLDCMLGRTRGKQQLNLGIEADNAPPKPFQKSRIRVPNPLSTLALLFEMPTGLVLLSNGINSAAYYAVTSTVPTQWNNIYHLNDFQLGLTYIPIGLGVILSAFTNGWLVDWNFQRIARQVGQLPIRNGKQDLRQFPIERARLQIAMPSAMLAAASIALYGWVIAAESPIVEALAMLLLIGYLYTAFYNVMNVLIVDLHYGKPATATAANNLVRCLLGAGATAGVTPLLDLLGRQWCFCVVGAIYVISLPLSGLVYKFVRGWREKRDAERDG

SEQ ID NO: 156 - protein, 531 aa, Artificial Sequence
  sequence variant 4 of ORF 16_9399
MGDHLIFLDQLVQGSLRMCPGSMHSSMAGSTAIPILRVTVDEASALLAPPSLPYSVFSPVRKLLIVFTAALASTFSPLSSNIYYPAINSIIDELKISAGYVNLTITAYMVFQGLTPAFMGDLSDTAGRRPVYVLCFGIYIVANIGLALQRDFVVLLVLRALQSTGGSAAVALSNAVAADTVTTAERGMYLGIFSLGGILGAALGPTLGGLLSQSLGWRSIFWFLALVAAVFFVLLMLFFPETCVATVGNGSIPPPRWVRSLLACMWGRTWGKTQLNLSPEVDNAPPKPHQKSRIRVTSPWSTPRLLFEMPTGLVLLSNGIGQAAVYAVGSTVPMQWNEYYHLNDFQLGLTYIPGGLGTILSAFTNGALVDWNFQRIFRQVGGLPIRNGKQDLRQFPIERYRLQIAMPSAMLAAASIALYGWVIAAQRPEVEALAMLLLIGYLVTASYNVMNVLIVDLHYGKPATATAALALVRCLLGAGATAGVTALLDKLGRFWCFCVVGAIYVISLPLSGLVVPFTAGAREKRDEEADG

SEQ ID NO: 157 - protein, 531 aa, Artificial Sequence
  sequence variant 5 of ORF 16_9399
MGDHDIFLDQIVQGSYRLCPGSTHSVMSTSTRIPNPRVTEDEGTALLAPVQPPYGVFSPVQQKLIVFTAALAQTFSALSSNIYYPAINSIADELKISTGMVNLTITAYMVFQGLTPAFMGFLSDTAGRRPVYVLCFGIYIVANIGLALQRDFLLLLVLRALQSTGISATVALSAAVAADWVTSAQRGMYLGIASLGGILGPALGPTLGGLLSQSLGWRSIFWFYALVAAVFFVLLMLFFPETCSAIVLNGSIDPPRWNASLLDCMVGRTRGYQQLNNSPEAINAPPKPHQKSRNLVPNPWSPMRLLFYMATGLVLLSNGIGYAAYYAVTSTVPTQWNEIYHLNDFQLGLTYIPIGLGTILSAFTNGGLVDWNFQRIASQNGQLPIRNGKQDLRQFPIERNRLKIAMPSAMLAAASIALYGWVIDGTAPIVEALAMLLLYGYLVTAIYNVMTVLIVDLHYLKPATATAACNLVRCLLGAGATAGVTPLLDHLGREWCFCVVGAIYVISLPLSGLVYGAGAGWRGKRTAERDG

SEQ ID NO: 158 - protein, 509 aa, Artificial Sequence
  sequence variant 6 of ORF 16_9399
MHSVMASSTKIPIPRVTVDEATALLAPPQPPYSVFSPVQKKLIVFTAALASTFSPLSSNIYYPAINSIADELKISPGMVNLTITAYMVFQGLTPAFMGDLSDTAGRRPVYVLCFGIYIVANIGLALQRDFVTLLVLRALQSTGISATVALSNAVAADTVTSAERGMYLGIASLGGILGPALGPTLGGLLSQSLGWRSIFWFLALVAAVFFVLLMLFFPETCRAIVGNGSIPPPRWNRSLLDCMVGRTRGKQQLNLSPEADNAPPKPHQKSRIRVPNPWSTLRLLFEMPTGLVLLSNGIGYAAYYAVTSTVPTQWNEIYHLNDFQLGLTYIPIGLGTILSAFTNGWLVDWNFQRIARQVGQLPIRNGKQDLRQFPIERARLQIAMPSAMLAAASIALYGWVIAAERPIVEALAMLLLIGYLVTASYNVMNVLIVDLHYGKPATATAANNLVRCLLGAGATAGVTPLLDLLGRQWCFCVVGAIYVISLPLSGLVYGFGAGWREKRDAERDG

SEQ ID NO: 159 - protein, 509 aa, Artificial Sequence
  sequence variant 7 of ORF 16_9399
MHSVMASSTKIPIPRVNRDEATALLAPPQAPYQVFSPVQKKLIVFTAALASTFVPLSSNIYYPAINSIADELKISPGMVNLTITAYMVFQGLTPAFMGDLSDTAGRRPVYVLCFGIYIVANIGLALQRDFVTLLVLRALQSTGISAPVALSNAVAADTVTSAERGMYLGIASLGGILGPALGPTLGGLLSQSLGWRLIFWFLALVAAVFFVLLMLFFPETCRAIVQNGSIPPPRWNRSVLDCMVGRDRGKQQLNLSPLADNAPPKQFQKARIRVPNPYSTLRLLFEMPTGLVLLSNGIGYAAYFAVTSTVPSQWNEIYHLNRPQLGLTYIPIGLGTILSAFTNGWLVDWNFQRIQRQVGQLPIRNGKQDLRQFPIERARLQIAMPSAMLAAASIALYGWVVASERPIVEALAMLLLIGYLVTASYNVMLVLIVDLHYGKPATATAANGLVWCLLGAGATAGVTPLLDLLGRQWCFCVVGAIYVISLPLSGLVYGFGAGWREKRLAERDG

SEQ ID NO: 160 - protein, 509 aa, Artificial Sequence
  sequence variant 8 of ORF 16_9399
MHSVMASSTKIPIPRVTVDPHGNLLAPPQAPYQVFSPVQKNLIVFTAALASTFSPLSLNIYYPAINSIADELKISPGMVNLTITAYMVFQGLTPAFMGDLSDTAGRRPVYVLCFGIYIVANIGVALQRDFVTLLVLRALQSTGISATVALSNAVAADTVTSAERGMYLGIYSLGGILGPALGPTLGGLLSQSLGWRWIFWFLALVAAVFFVLLMLFFPETCRAIVGNGSIPPPRWNASELDCMVGRTRGKQQLNLSPEADMLPPEPPQQVRIRVPNPWSTLRLLFEMPTGLVLLSNGIGYAAYYAVTSTVPTQWNEIYHLNDFQLGLTYIPIGLGTILSGFTNGWLVDWNFQRIARQVGSLPIRNGKQDLRQFPIERARLQIAMPSAMLAAASIALYGWVIAAERPIAEALAMLLLIGYLVTASYNVMNVLIVDLHYQKPATATAANNLVLCLLGAGATAGVTPLLDLLGRHWCFCVVGAIYVISLPLSGLVYGFGRGWREKRDAERDG

SEQ ID NO: 161 - protein, 509 aa, Artificial Sequence
  sequence variant 9 of ORF 16_9399
MHSVQMSSTKIPIARVPVDEALALLAPPQPPYEVWSPGQKKLIVFTAALAYTFSPLSSNIYYPAINLIADELKISPGVVNLTITAYMVFQGLTPAFMGDLSDTAGRRPVYVLCFGIYIVANIGLALQRDFITLLVLRALQSTGISATVALSNAVAADTVTSAERGMYLGIAELGGILGPALGPTLGGLLSASLGWRHIFWFLALVAAVFFVLLMLFFPETCAAIVGNGSIGPPRWNRSKLDCMLGRTRGEQYLNSGPAADNAPPKPHQFSRIRVPNPWSTLRLLFEMPTGLVLLSNGIGYAAYYAVTSTVPTQWNEIYHLNDFQLGLTYIPIGLGTILSAFTNGNLVDWNFQRIARQVGQLPIRNGKQDLRQFPIERARLQIAMPSAMLAAASIALYGWVSAAERPIVEALAMLLLIGYLVTASYNVMLVLIVDLSYGKPATATAAMNLVRCLLGAGATAGVTWLLDVLGQQRCFGVVGAIYVISLPLSGLVYGFGAGWREKRDPERDG

SEQ ID NO: 162 - protein, 509 aa, Artificial Sequence
  sequence variant 10 of ORF 16_9399
MHSVMASSTKIPIPRVTVIEATAMLAPAQLPYSVFSPVQKRLIVFTAALASTFSPLTSQIYYPAINSIQDELKISPGMVNLTITAYMVFGGLTPAFMGDLSDTAGRRPVYVLCFGIYIVANIGLALQRDFVFLLVLRALWSTGLSALSALSIAVAADTVTSAERGMYLGIATLGGALGPALGPTLGGLLSQSLGWRSIFWFYALVAAVFFVLLMLFFPETCRYILANGSIPPPGWNNSLLDCMVFRTRGKQQLNLSNLADNAPPVPEQKWRLEVPNPLQTLRLLFEMWTGLVLLSNGIGHAAYYAVTSTVPTQWLEIYHLNDFQLGLTYIPYGLGTILSAFTNGWLVDWNFQRKARQVGQLPIRNGKQDLRQFPIERYRLQIAMPSAMLGAASIALYGWVRNAEEPIVEALAMLLLIGYLYTASYNVLNVLIADLHYEKPATATAANNLVRCLLGAGATAGVTPLLDHLGYQWCFCVVGAIYVISLPLSGLVYGFSAGWREKRDAEREG

SEQ ID NO: 163 - protein, 509 aa, Artificial Sequence
  sequence variant 11 of ORF 16_9399
MHSGDMSATPAPIPRVTHDAATAELSPPQPPYSEFTPVQKKLIVFTAALATTFSPLSSNIYYPAINSIAQELKISPGMVNLTITAYMVFQGLTPAFMGDLSDTAGRRPVYVLCFGIYIVATIGLALQRDFTGLLVLRALQSTGESATVALSRAVAADTVTSAYRGLYLGIATLGGILGPALGPTLGGLLSQSLGWRSIFWFNALVAAVFFVLLMLFFPETCRARVSNGSINQPRWNRSLLDCMVGRKPGKQQLNLSPEADFAPPKPHQLSRFRVPNPWSTIELLFEMPTGLVLLSNGIGYAAMYAVTSTVPTQWHEIYHLNDVQLGLTYIPIGLGTILSNFTNGWLVDWNFQRYKRQVGQLPIRNGKQDLRQFPIERARLQIAMPSAMLAAASIALYGWVGAKEPPIPEALAMLLLIGYLVTASNNVMNVLIQDLHYGKPATATAAWNLVECLLGAGATAGVTPLLDLFGRQWCFCVVGAIYVISLPLSGLVYGFGAGWREKRGAPRDG

SEQ ID NO: 164 - protein, 275 aa, Artificial Sequence
  sequence variant 1 of ORF 17_9399
MVCTKLFSTALVAAALVLPGSALSIISFQKPMEDPHLCDGTGIVDPDGNCNGDGVIDDPPARPPRFGNPPPHEGPDRDGFKFENPSTQCKYMSQPDLWDNFKSLEKDMNKIFTMIHKDVDFTIVGHHPGAGHYTDLLHFYTNALRRYSVCFKQYPEYFRVYPQAIHGGCNSEWSVQEINFLGTTNSGVPFDVINVWVTRWKDGQMVEVRTYIDSMRMTGLLHENELWWNSSTYEHHYNYIPGPTGLPDLDELRGLMRKPDGSRSTDLPHLIWPLH

SEQ ID NO: 165 - protein, 275 aa, Artificial Sequence
  sequence variant 2 of ORF 17_9399
MVATKLFSTALVACTLVLPGSALSSIPFQKPMENPHLCDGTGIVDPDGNCNGDGVIDPPQARPPRFGNPPPHEGRYRDGFRFENPSTQCKYMSQPHLWDNFKSLEKDMSKIFTMIHKDVDFTIVGHHPGAGHYTDLLHFYTNALRRYSVLFSQYPEYFRIYPQAIHGGCNSEWSVQEILFLGTTNHGEDFDVINVWVTRWKDDQMVEVRTYIDSMRMTGLLHENELWWNSSRYEEHINYIPGPTGLPDLDELRGLMRKPDGSRSTDLPHLIWPLH

SEQ ID NO: 166 - protein, 275 aa, Artificial Sequence
  sequence variant 3 of ORF 17_9399
MVLTKLFSTALVAIALVLPGTALSVIPFQIPMEAPHLCDGTGIVDPDGNCNGDGVIDSPPAPPPRFGNPPPHEGKYRDGFKFENPSTQCKYMSQPDLWDNFKSLEKDMSKIFTMIHKDVDFTIVGHHPGAGHYTDLLHFYTNALRRYSVCFSEYPEYFEIYPQAIHGGCNSEWSVQEINFLGRMNHGVDFDVINVWVTRWKDGQMVEVRTYIDAMRMTELLHENELWWNSSTFEEHIQYIPGPTGLPDLDELRDLMRKPDGSRSTDLPHLIWPLH

SEQ ID NO: 167 - protein, 275 aa, Artificial Sequence
  sequence variant 4 of ORF 17_9399
MVATKLFSTALVAALLVAAGSIGASIPFQKPMENPHLCDGTGIVDPDGKCNGDGVIDSPPPRPPRFGNPPPHEGRDRDGFKFENPSTQCKYMSQPWLWDNFKDLEKDMSKIFTMIHKDVDFTIVGHHPGAGRYTDLLHFYTNALRRYSNIFSQYPEYFEIYPQAIHGGCDSAWSVSEIQFLGRMNHGVDFDVVNVWVTRWYDGQMVEVRTYIDSPRMTGLLHRNELWWNSSTFEEHPNYIPGPTGLPDLDNLRDLMRKPDGSRSTDLPHLIWPLH

SEQ ID NO: 168 - protein, 275 aa, Artificial Sequence
  sequence variant 5 of ORF 17_9399
MVLTAPFSQALVACILVLPGTGLSIIPFQKPMEEPHLCDGTGIVDPDGNCNGDGVIDPPPNRPPRFGNPPPHEGRDRDGFRFENPSTQCKYMSQPHLWDNFKTLEKDMSKIFTMIHKDVDFTIVGHHPIAGHYHDLLHFYTNALRRYSVIFSQYPEYFRIYPQAIHGGCNAEWSVQEVNFIGVTNHGDDFDVINVWVTRWKQGQMVEVRTYIDSMRMTDLLHENELWWNSSSLEHHPNYIPGPTGLPDLDELRGLMRKPDGSRSTDLPHLIWPLH

SEQ ID NO: 169 - protein, 267 aa, Artificial Sequence
  sequence variant 6 of ORF 17_9399
MVATKLFSTALVAAALVLPGSALSIIPFQKPMENPHLCDGTGIVDPDGNCNGDGVIDEPPARPPRFGNPPPHEGRDRDGFKFENPSTQCKYMSQPDLWDNFKSLEKDMSKIFTMIHKDVDFTIVGHHPGAGHYTDLLHFYTNALRRYSVCFSQYPEYFRIYPQAIHGGCNSEWSVQEILFLGRTNHGVDFDVINVWVTRWKDGQMVEVRTYIDSMRMTGLLHENELWWNSSTYEEHPNYIPGPTGLPDLDELRGLMRKPDGSRYDDM

SEQ ID NO: 170 - protein, 267 aa, Artificial Sequence
  sequence variant 7 of ORF 17_9399
MVATKLFSTALVAFILSLPASALSVIPFQSPMLNPHLCDGTGIVDPDGNCNGDGVIDEPPARPPRFGNPPPHEGRDRDGFKFENPSTQCKYMSQPDLWDNFKSLEKDMSKIFTLIHKDVDFTIVGHHPGAGHYNDLLHFYTNALRRYSVCFSQYPEYFRIYPQAIHGGCNSEWSVQEILFLGRLNHGVDFDVINVWVTRWHQGQMVEVRTYIDSMRMTGLLHRNELWWNSSTYEEHPNYIPGPTGLPDLDELEGLMRKPDGSRYDDM

SEQ ID NO: 171 - protein, 267 aa, Artificial Sequence
  sequence variant 8 of ORF 17_9399
MVATKLFSPALVAAALVLPGTALSFIPFQKPMEGPHLCDGTGLVDPDGNCNGDGVIDEPPAPPPRFGNPPPHEGKYRDGFKFENPSTQCKYMSQPDLWDVFKSLEKDMSKIFTMIHKDVDFTIVGHHPGAGHYTDLKHFYTNALRRYSVCFSQYPEYFRIYPQAIHGGCNEQWSVQEILFLGQMNHGVDFDVINVWVTRWKDGQMVEVRTYIDSMRMTGLLHENELWWNSSTYEEHPNYIPGPTGLPDLDELRGLMRKPDGSRYDDM

SEQ ID NO: 172 - protein, 267 aa, Artificial Sequence
  sequence variant 9 of ORF 17_9399
MVAFKLFSTALVAFALVLPGSALSIISFQKPMEKPHLCDGTGIVDPDGNCNGDGVIDSPPARPPRFGNPPPHEGRDRDGFKFENPSTQCKYMSQPDLWDNFKDLEKDMSKIFTMIHKDVDFTIVGHHPGAGHYTDLLHFYTNALRRYSVCFIQYPEYFRIYPQAIHGGCNSAWSVQEILFLGVTNHGVPFDVINVWVTRWHDGQMVEVRTYIDSPKMTELLHENEIWWNSSTFEEHLEYIPGPTGLPDLDELRKLMRKPDGSRYDDM

SEQ ID NO: 173 - protein, 267 aa, Artificial Sequence
  sequence variant 10 of ORF 17_9399
MVCTKYFSTALVAITLVLPGSALSIIPFQSPMDGPHLCDGTGIVDPDGNCNGDGVIDDPPARPPRFGNPPPHEGAPRDGFKFENPSTQCKYMSQPDLWDSFKDLEKDMSKIFTMIHKDVDFTIVGHHPGAGHYNDLMHFYTNALRRYSVCFSQYPEYFEIYPVAIHGGCNSEWSVQEFNFIGLTNSGDDFDVVNVWVTRWKDGQMVEVRTYIDSMRMTELLHENELWWNSSTFEEHMNYIPGPTGLPDLDELRGFMRKPDGSRYDDM

SEQ ID NO: 174 - protein, 267 aa, Artificial Sequence
  sequence variant 11 of ORF 17_9399
MVATKYFSQALVAFTLVLPAGAASIIPFQKPMEEPHLCDGTGIVDPDGRCNGDGVIDEPPARPPRFGNPPPHEGRDRDGFEFENPSTQCKYMSQPHLWDSFKTLEKDMTKIFTMIHKDVHFTIVGHHPGAGHYHDLLHFYTNALRRYSVVFSQYPEYFRIYPQAIHGGCNEQWSVQEILFKGQTNHGVTFDVINVWVTRWKDGQMVEVRTYIDQMRMTGLLHENEIWWNSSTHEDHSNYIPGPTGLPDLDELRGLMRKPDGSRYDDM

SEQ ID NO: 175 - protein, 509 aa, Artificial Sequence
  sequence variant 1 of ORF 18_9399
MQAYDQVIVDIKSYVFHYDIHSPDAWTTARVVLLDAMGCAIETVALSADCRRFFGPIVSDTVTPYGFHMPGTSYVLDPLKGSFDMATAVRYLDHNDAIAGADWGHPSGILFPFLLFETKKPRTVADMVRADNLGAILAVSDWLCRPVASCRIVHTGPPLTMRTLLTALIKAYEIQGCMLLQNAFTSHGLDHVVWVKLASTAVVAWLLGLSETQTMAAISQVWMQGHPLRVYRSGSNTIPRKGWAAGDACMKATLLALLTRAGQPGTPTPLTMPRWGFYATSFGNKTQDIPHPYGSWVMEQIIFKVMPVEGHALSSVEAALRHRAAMQARGIKHPEKDIDCIEIRTNAAADMIINKDGPLSNAADRDHCLQYIVSLAFLKGAMPEVGDYQDDSVWSSSRAITALREKIEIQPDEQLTRDYLDLDVKSLASGMTVELIDGTYLDQILVHYPVGHSKHPQTFTTVREKVRRNLSPMFSTEEISRMVAAVEEESDGISGFVRLFVRPRSEVKL

SEQ ID NO: 176 - protein, 509 aa, Artificial Sequence
  sequence variant 2 of ORF 18_9399
MQAYDQVIVQIKDYVFHYDIHSPQAWTTARVALLDAMGCAIETVALSADCRRFFHPIVPDTVTPYGFHMPGTSYVLDPLKGSFDMATAVRYLDHNDAIAGADWGHPSGILFPFLLFETKKPRTVADMVRADNLGAILAVSDWLCRRVASCRIVHTGPPLTMRTLLTALIKAYEIQGCMLLQNAFHSHGLDHVVLVKLASTAVVAWLLGLSETQTMAAISQVWMQGHPLRVYRSGSNTIPRKGWAAGNACMKATHLALLTRRGQPGSPTPLTMPRWGFYATSFGNATFDEPREYGSWVMEGIIFKVMPVEGHALSSVEAALRHRAALQARGMDHPEKDIDCIEIRTNAAAAMIINKRGPLNNDADRDHCLQYIVSLAFLKGAMPGVRDYQDDSVWSSSRAITALREKIQIRPDEQLTRDYLDLDVKRLASGMTVILIDGTVLDEILVHQPVGHSKHPQTFTTVREKVRRNLSLMFSEEEIQAMEAALSEESLGISGFVDLFVRPRSEVKL

SEQ ID NO: 177 - protein, 509 aa, Artificial Sequence
  sequence variant 2 of ORF 18_9399
MQRYDQVIVLIKDYVFHYQYHSPAARTTARVALLDAMGCAIETAADSAACRRFFGPIVPDTVTPYGFHMPGTSYRLDPTKGSFDMATAVRYLDHNDAIAGADSGHPSGILFPFLLFETKKPRTVADMVRADNLGAILAVSDWLCRSVASCRIVHTGRPLTMRTLLTALIKAYEIQGCMLLQNAFTSRGLDHVVLVKLASTAVVAWLLGLSTTQTYHAISQVWMEGHPLRVYRSGSNTIPRKGWAAGDACMKATHLAQLTMAGQPGSPTPLTMPRWGFLATSFGNKTFDLPQPYGSWVMEQIIFKVMPVEGHALSSVEAALRHRAAMQARGMKHPEKDIDCIEIETNTAADMIINKMGPLSNAADRDHCLQYIVSLAFLQGKMPGVRDYADDSVTSSSRAITALRAKIQIQPDEQLTRDYLDLDVKNLASGMTVTLIDGTVLDEILVHFPVGHSKHPQTWTTVREKVRRNLSLMFSTEEISDMEAAVEEESLGISGFVDLFVRPRSEVKL

SEQ ID NO: 178 - protein, 509 aa, Artificial Sequence
  sequence variant 4 of ORF 18_9399
MQEYDRVIVDIKDYVFHTSIHSPQAWTTARVCLLDAMGCAIETVALSAICRRFFGPAVHDTVTPYGFHMPGTSYVLDPYKGSFDMATAVRYLDHNDAIAGADWGHPSGILFPFLLFETKKPRTVADMVRADNLGAILAVSDWLCRSVASCRIVHTEPPLTMRTLLTALIKAYEIQGCMLLQNAFHSTGLDHVVLVKLASTAVVAWLLGLSATQTIAAISQVWMDGHPLRVYRSGSNTIPRKGWAAGDACMKATHLAYLTQAGQPGSPTPLTMPEWGFAATSLGNEEFDLEAPYGSWVMENIHFKVMPVEGHALSSVEAALQHRAAEIARGNKHPEKDIDCIEITTHADADHIINLRPPLANAADRDHCLQYIVSLAFLKGSMPEVRDYQDDSVRSASRAIRALREKIQIQPDESLTRRYLDLDVKSLASGMTVRLSDGTVLDEILVHAPVGHSKHPQTFTTVVEKVRGNLGLMFSQEEISRMEAAVAEESRGISDFVSLFRRPRSEVKL

SEQ ID NO: 179 - protein, 509 aa, Artificial Sequence
  sequence variant 5 of ORF 18_9399
MQAYDQVIADIKDYVKASDIHSPQALETARDSLLDAMGCAIETVALSALALRFFAKIVEDTVTPYGFHMPGTSYRLDPLFGSFDMATAVRYLDHNDAIAGADWGHPSGILFPFLLFETKKPRTVADMVRADNLGAILAVSDWLCRKVASCRIVHTGPPLTMRTLLRALIKAYEIQGCMLLQNAFHSHGLDHVVLVGLASTAVVAWLLGLSETQTMAAISQVWMAGHPLRVYRSGSFTIPRKGWAAGVACMKATHLARLTRTGQPGSPTPLTMPRWGFYATSFGNPTFDLPQAYGEWVMENIGFKVMPVEGHALSSVEAALEHRAAMQKRGFKHPEKDIDCIEIYTNAAALKIINKREPLRNAADRDHCLQYIVSLAFLKGAMPEVRDYDDDSVWSSSRAITALREKIQIQPDEDLTRDYLDLEVKSTASGMTVRLADGTKLDEIIVHFPVGHSKHPQTFTTVREKVRRNLSLVFSTEEISRMLAAVDEESLGIRSFFDLFVGDRSEVKL

SEQ ID NO: 180 - protein, 486 aa, Artificial Sequence
  sequence variant 6 of ORF 18_9399
MQAYDQVIVDIKDYVFHYDIHSPQAWTTARVALLDAMGCAIETVALSADCRRFFGPIVPDTVTPYGFHMPGTSYVLDPLKGSFDMATAVRYLDHNDAIAGADWGHPSDNLGAILAVSDWLCRSVASCRIVHTGPPLTMRTLLTALIKAYEIQGCMLLQNAFHSHGLDHVVLVKLASTAVVAWLLGLSETQTMAAISQVWMDGHPLRVYRSGSNTIPRKGWAAGDACMKATHLALLTRAGQPGSPTPLTMPRWGFYATSFGNKTFDLPQPYGSWVMENIIFKVMPVEGHALSSVEAALRHRAAMQARGMKHPEKDIDCIEIRTNAAADMIINKRGPLSNAADRDHCLQYIVSLAFLKGAMPEVRDYQDDSVWSSSRAITALREKIQIQPDEQLTRDYLDLDVKSLASGMTVRLIDGTVLDEILVHFPVGHSKHPQTFTTVREKVRRNLSLMFSTEEISRMEAAVEEESLGISGFVDLFVRPRSEVKL

SEQ ID NO: 181 - protein, 486 aa, Artificial Sequence
  sequence variant 7 of ORF 18_9399
MQAYDDVIVDIKDYVFHYDIDSPQAWTTARSALLDAMGCAIETVADSADCGRFFGPIVPDTVTPYGFHMPGTGYVLDPLKGSFDMATAVRYLDHNDAIAGADIGHPSDNLGAILAVSDWLCRSVASCRIVHTGPPLTMRTLLTALIKAYEIQGCMLLQNAFHSHGLDHVVLVKLASTAVVAWLLGLSETQTMAAISQVWMDGHPLRVYRLGSNTIPRKGWAAGDACMKATHLALLTLAGQPGSPTPLTMPEWGFYAMSFGNKTFNLSQPYGSWVMENIIFKVMPVEGHALSSVEAARAHRAAMQARGMKHPEKDIDCIEIRTNAAADMIINKRGPYSNAADRDHCLQYIVSLAFLKGAMPEVRDYQDDSVWSSSRAITALREKIQIQPDEQLTTPYLDLAVKSLASGMTVRLIDGTVLDEILVHAPVGHSKHPQTFTTVREKVRKNLSLMFSQEEISRMEAALEEESLGISEFTDLFVRPRSEVKL

SEQ ID NO: 182 - protein, 486 aa, Artificial Sequence
  sequence variant 8 of ORF 18_9399
MQAYDQVIVDIKDYVFHYDWHSPQAVTTARVALLDAMGCAIETVALSADCRNFFQPIVEDTVTPYGFHMPGGQYVLDPLLGSFDMATAVRYLDHNDAIAGADWGHPSDNLGAILAVSDWLCRSVASCRIVHTTPPLTMRTLLTALIKAYEIQGCMLLQNAFHSRGLDHVVLVKLASTAVVAWLLGLSETQTMAAISQVWMDGHPLRVYRSGSNTIPIKSWAAGWACMKATELALLTRAGQPGSPTPLTMPRWGFYATSFGNKTFDLPQRYGSWVMENIIFKVMPVEGHALSSVEAALRHRAAMQAKGMKHPEKDIDCIEIRTNQAADMIINNRGPLSNAADRDHCLQYIVSLAFLKGAMPSVRDYQDDSVWSSSRAITALRAKIQIQPDEELTRDYLDLDVKSLASGMTVRLIDGTVLTEILVHFPVGHSKHPQTFTTVREKVRRNLSLMFSTEEISRMEAAVEAESLGIPGFVDLFIRPRSEVKL

SEQ ID NO: 183 - protein, 486 aa, Artificial Sequence
  sequence variant 9 of ORF 18_9399
MQAYDQVIVDIKDYVTHYDIHSPQAWTKARVALLDAMGCAIETVALSADCRRVFRNIVPDTVVPYGFHMPGTSYVLDPVKGSFDMATAVRYLDHNDAIRGADWGHPSDNLGAILAVSDWLCRSVASCRIVHTRPPLTMRTLLAALIKAYEIQGCMLLQAAFYSHGLDHVVLVKLASTAVVAWLLGLSETQTMAAISQVWMDGHPLRVYRSGSNTIPRKGWAAGDACMKATHLALLTRAGQPGYPTPLTMPEWGFAATSFGNKTFDLPSPYGSWVMENIGFKVMPVEGHALSSVEAALRHRRAMQAHGMKHPEKDIDCIEIRTNQAAVRIINKRGPLSNAADRDHCLQYIVSLAFLKGAMPEVRDYQDDSVASSSRAIKALREKIQIEPDEALTRDYLDLDVKSIASGMTVRLIDGTVLDKILVHFPVGHSKHPQTWTTVREKVRRNLSLMFSTEEISPMEATVEEESRGISEFMTLFVRPRSEVKL

SEQ ID NO: 184 - protein, 486 aa, Artificial Sequence
  sequence variant 10 of ORF 18_9399
MQDYDQVIVQIKDYVRHKKIHSPQAWVTARVALLDAMGCAIETVALSADCRRFFGPIVPDTYTPYGFHMPGTSYQLDPLKGSFDMATAVRYLDHNDAIAGADWGHPSDNLGAILAVSDWLCRRVASCRIVHTTPPLTMRTLLTALIKAYEIQGCMLLQFQFYSHGLDHVVLVKLASTAVVAWLLGLSETQTMAAISQVWMDGHPLRVYRSGSNTIPRKGWAAGLACSKATHLAWLTRHGQPGSPTPLTMPRWGFYAASLGNKTFDPPQPYGDWVMTNILFKVMPVEGHALSSVEAALRHRARMQARGMKHPEKDIDCIEIRTNAAADGIINKERPLKNGADRDHCLQYIVSLAFLHGTMPHVRDYQDDSVWSSSRAITALREKIHIQPDEQLTREYLDLDVKRRASDMTVRLIDGTVLDEILVEHPEGHSKHPQTATTVLEKVRTNLKLMFSTEEISRMAAAVEEESMGINGFVELFVEPRSEVKL

SEQ ID NO: 185 - protein, 486 aa, Artificial Sequence
  sequence variant 11 of ORF 18_9399
MQAYDQVIDRIKDYVFSYDVDSPQAATEARVALLDAMGCAIETVPLSADCRRAFRPIVPDTVTPYGFHMPGDSAVLDPLKGSFDMATAVRYLDHNDAIAGADWGHPSDNLGAILAVSDWFCRTVASCRIVHTGPPLTMRTLLTALIKAYEIQGCMLLQIATNKHGLDHVVWVKLASTAVVAWLLGLSETQTMAAISQVWMDGHPLRVSRSGSNTIPRKPWAAGDACMKATVLALLTRAGQPGSPSPLTMPRDGFYAVSFGNKTFDLPQPYGSWVMENIIFKWMPVEGHALSSVEAALRHRARVKARGMKHPEKDIDCIRIYTNAAADMIINKRGPKHNQEDRDHCLQYIVSLAFLDGTMPAVRDYQDDSVWSLSRAITALREKIQIQPDEQLTRDYLDLDVKSLASEMTVRLIDGTVLDEILVVFPVGHSKHPQTFTTVLEKVRDNLSAMFSTEAIERMEAAFEEESLGISGFVDLFVLARSEVKL

SEQ ID NO: 186 - protein, 200 aa, Artificial Sequence
  sequence variant 1 of ORF 19_9399
MPKDNSAEFHFIQGDVEADPGPGIEGFYAGPYYSFYAFPRTFPDSDDEEPDGGYISMFEAYEMIYDIIAEEGPFDGILGFSHGGTLASGFLIHHSKTSPYGPPPFRCAVFFNSLPPFRMDPGEELVVDDDLARHLTIPTLSIAGTRDQVYKQSLMLHQLCDEKSSQLIEHGKGHYIPGDAATVARMAKAFRALCQRAMYL

SEQ ID NO: 187 - protein, 200 aa, Artificial Sequence
  sequence variant 2 of ORF 19_9399
MPKDNSAEFHFIQGDVEADPGPGIEGFYQGPYYSFYQFPTTFPDSDNEEDDGTDASMFEAYETIYDIIDEEGPFDGILGFSHGGTLASGFLIHHSKTSPYTPPPFRCAVFFNSLPPFRMDPGEELVVDDDLARLLTIPTLSIAGTRDPVYKQSLMLHQLCDEKSSQLILHGKGHEIPGDAATVLRMAKVFRALCLRAMYL

SEQ ID NO: 188 - protein, 200 aa, Artificial Sequence
  sequence variant 3 of ORF 19_9399
MPKDNTAEFHFIQGDVPADPGPGIGGFYEGPYYSFYQFPRDFPDSDDEEDDGGDASMLEAYEMIYDIIAEEGPFDGILGFSHGGTLASGFLIHHSRTLPYTPPPFRCAVFFNSLPPFRMDYGEYLVVDDDEAIHLTIPTLSIAGTRDFVYKQSLMLHQLCDEKSSQLITHGKGHAIPGDAATVARMAKFFRALCLRAMYL

SEQ ID NO: 189 - skipped

SEQ ID NO: 190 - protein, 200 aa, Artificial Sequence
  sequence variant 5 of ORF 19_9399
MPKDNSAEFHFIQGDVEASPGPGIEGVYDGPYYSFYQFPRTFPDSDDEEDKGGDASMDEAYEMIHDIIEEEGPFDGILGFSHGGTLASGFLISHSHTSPDTPPPFRCAVFFNSLPPFDMDPGEELIVDDDGRPHLTIPTLSIAGTRDFVYKLSLMLHQLCDEKSSQLIDHGKGHEIPVDAADVARMAKAFRALCSRAMYL

SEQ ID NO: 191 - protein, 2451 aa, Artificial Sequence
  sequence variant 1 of ORF 20_9399
MVENVSSPSSPRTSSPSGSCTPTSATSVGSDDKSMPIAVVGMSFRGPRDAISVESLWRMISEGREGWSKIPDSRWNNDAFYHPDHSRHGTIQVEGGHFLEEDLARFDAPFFNMTNAEAAALDPQQRLLLESTFEAVENAGIPLDKMTGSKTSCFVGSFCGDYTDMLVRDVEAIPMYQCTNAGQSRAITANRVSYFFDLRGPSVTVDTACSGSLVALHLACQSLRTGDAKMAIVSGVNTILSHEFMSTMSMMRFLSPDGRCYTFDERANGYARGEGVGCLLLKPLSDALRDNDTIRAVIRGTGSNQDGKTDGITLPNANAQQELIRDVYAAAGLDPLETEYVECHGTGTQAGDPLETGAVAKVFSPGRPDDRPLRIGSIKTNVGHLEGASGIAGVIKAVLTLENQCFLPNRNFKSINPRIPLKEWKLKIQLENERWETVGPHRVSVNSFGYGGSNAHAVLEDTKGELMQREVTGSFRRVRALPRAATDLEPVSRPGAFPDGTRLFVLSSFDQASGQQQIDQLREYLEQNSGRIDDQYLADLAYTLGERRSPFLWKTAMPASSQSSLVEGLKTRAKVSRAKKKKPTLGFIFTGQGAQWCGMGRELLAAYPVFASSVDAIATYLKSLGPPFDVREELVRDPKDSKINQPLYSQPICTAVQIALVDLLTFWGIRPASVTGHSSGELAGAYTAGALSMEHSMAAAYYRGVASSDLPRDLTQAGAMMAVGASKDAIQPRLSSLTSGTAVVACVNSPASVTISGDASAVDELHGLLEKDQVFARKLAVDVAYHSHHMKAVADQYRTAMAAAGVTAVSPESREPEVEFFSSVTGEKASLTDLGIEYWVANLLSQVKFADSVHRLCMTTSASGRARKTKTKAPKRSGATNKAKVDMLVEIGPHSTLAGPIRQILGSDQTLEQAKIRYASALLRKSSAVDTTLTLASTLLMAGYPIDMAAINRPSDHHGVGVLVDLPPYPWNHSGSYWLEPRLSKAYRNRKHPRNDLLGVADTHSSFREPRWRNYLRTSEIPWIKDHMIQSNVVYPAAGYLTMAVEAIGQRIGDNFRGHRISGYRLRDVEIEAALVISDGSEPEVMLSLRPAGDSGLVGAERWHEFHVSSVTPDNRWTEHCRGLICAEQAAMDSDEDDRGAEAGLTAETERWIEEANQLCQKDVDIPRFYASLTGLGLEYGETFANMTRARSASHACLAEIEVADTSAVMPLGFQSPFVVHPSTLDSLFHPLFVALSSDESGQTPAVPVAIEEIWIHHGGAKEAGHAFEVCASTQETGRDRIQAAISVVDAQRNRSGPALTVRGLTCQFLDRASGDVEGDESPTRWAYELHWEADIDLLSSSDLARLCAVGRPRDVYEKVAEYVKLLGHKNPLLAILEVGAGQGELCNRVFRALAGEAGSTPSFQNYTLADTEPGLSENIATIADQFDGRADLIQYKELDISKDPLQQGFNAHSLDLILLPSRGVSATKREKILKHAHQLLTPEGRLIVVDTRDLQGWWEALRESNFTDPEVIFDSPDETLADHSVLVSKPQPQPRDLTPSDPPDVLVIAENGDPGERIEHLKRSLADAHVKATVTDFAHADPEGKICIVLSELTTSLLSHPDQHSFETLKRILVAGGSRVLWVVRGATCPAPTSSLATGLLRTIRTETDDDRPIVSLDLDESHDLSAESAAQSIFSAFRQRFVSPGASHEVEYAERDGILRIPRVVESSEVNEGIVSSLRPAVAEDQPFFQPGTPLELAVGAPGLLDSLYYVDRSCISELPSDYVEIEVKAIGLGNGDVKTALGKDDAATRLGAECSGVVTALGDAVSGFKIGDRVAGFGAGTVATLYRDQAARFQLIPDDMSFARAAALPVAYITAFFAVHALGQVSRGDRVLIQDAGTAAGQALLELCALAGGDIIAVVDSPSQRAFLVGEYDLPASRILVGLRGRRLATSVMTLTRGCGVDAIFNFRGGEERRLCWSCVAPYGRFIDLGGGPSDLTDMTQLEMASFFSKNASFTALDFHYLVTRKPNAVERIWSDVMALVRAKAIRGPPRLQLHSVSEVETALKQSQDGCDVEKVVIRAERDTIVQAIPPPKGDLLRADASYVLVGGLGGIGRAMASWMIANGARHLIFVNRSGLARNAARETVESLEGHGAHVAVYSCDVSDRDQVAQMVAQSSKEVPPIRGVIQAAMILRDMLFEKMSVDDFNTVLQPKWQGTWNLHGLLPRDMDFFIMLSSISGVIGNATQAAYAAGSTFLGAFAQYRSSAGLPAVTLDLGVITGIGYLSEHEALLQGMQRLGFEGTNEQTLMALIRSAIVSPRRTGSQAEIVTGLGTWKEGVSNGNADQPLFAHFCRQRLGLRDATAEGTGGSVRESLRGCTTLDDATRLVCAHLIDRLAARLNTPVDNIDSQRAMSEYGVDSLVAVEMRNWIGKEMESTMPILELLANQSISQLSRKIAQRSKVVASSGSEE

SEQ ID NO: 192 - protein, 2451 aa, Artificial Sequence
  sequence variant 2 of ORF 20_9399
MVENVSSPSSPRTASPSGSCTPGSAQSVGRDDKSMPIAVVGMSFRGPRDAISVESLWRMISEGREGWSKIPKSRWNDDAFYHPDHSRTGTINVERGHFLEEDLARFDAEFFNMTNAEAAALDPQQRLLLESTFEAVENAGIPLDKMLGSKTSCFVGSFCGDYTDMLVRDPEAIPGYQCTNAGQSRAITANRVSYKFDLRGPSVTVDTACSGSLVALHLACQSLRTGDAKMAIVSGVNTILSHELMSTMSMMRFLSPDGRCYTFDERANGYARGEGVGCLLLKPLSDALRDNDTIRAVIRGTGSNQDGKTSGITLPNANAQQELIRDVYAAAGLDPLETEYVECHGTGTQAGDPLETGAVIKVFSPGRPDDQPLRIGSIKTNVGHLEGASGIAGVIKAVLTLENQCFLPNRNFKSINPRIPLKEWKLKIQLENERWETVGPHRVSVNSFGYGGSNAHAVLEDTKGYLEQRSLQGSFRRVRHLPPAATDLEPVPDRPSGPERTALFVLSSFDQASGQQQIDQLREYLEQNSERIDDQYLADLAYTLGERRSPFLWKTAMPASSVSSLVEGLKTRQVVSRAEKKKPTLGFIFTGQGAQWCGMGRELLAAYPVFASSVDAIATYLKGLGAPFDVREELVRDPKDSKINQPLYSQPICTAVQIALVDLLTFWGIRPASVTGHSSGELAGAYTAGALSMEHSMAAAYVRGVASSELPRDHTQRGAMMAVGASKDAIQPRLSSLTTGTAVVACVNSPSSVTISGDASAVDELHGVLEKDQVFARKLAVDVAYHSHHMKAVADQYRTAMAAAGVTASQPESREPEVEFFSSVTGELASLTDLGIEYWVANLLSQVKFADSVHRLCMETSASGRQRKTKTKAPKRSGANNKAKVDMLVEIGPHSTLAGPIRQILGADQTLEQASIRYASALLRKSSAYDTTLTLASTLLMAGYPIDMAAINNPSDTHRVAVLVDLPPYPWNHSGSYWAEPRISKAYRNRAHPRNDLLGVLDTHSSGREPRWRNYLRTSEIPWIKDHMIQSNVVYPAAGYLTMAVEAIGQRIGDNFPGHRISGYRLRDVTIEAALVISDDSEPEVMLVLRPSLISGLVPAERWHEFHVLSVTPDNRWTEHCRGLICAEVPAMDAREDDRGAEAAYTAETERWIEEAEQLCQKDVDIPRFYAELTGLGLEYGETFANMTRARSASHVCLAEIEVADTRAVMPHGFQFNFVVHPSTLDSLFHPLFVALQSDESLQDPAVPVAIEEIWIRHGMAKEAGSKFQVCAKTQENGRDQIQAAIAVVDAQRARSGPALTVRGLTCQFLDRAAGDQEGDEQTTRLAYELHWRADVALLSSSDLATLCAVGRPRDVEEAVARYVKLLGHKNPHLAILEVGAGQGELCIPVFRALAGEANSTPSFQTYTLADTEPGLSETIDTIADQFNERSDLIHYKELDISSDPVQQGFNAHSLDLILLPARGVSATVRSKILKHAHQLLTPEGRLIVLDTRDLQEWDQALRESNFTDPEVIHDSPSPTEADISVLVSKPMPQPRDQTPSDPPDVLVIAEVQDSGVSIEHLLRHLADAHVPATVTDFAHLAPEMMTCIVLSELTGSLLSHPDQHSFESLKRILVAGGRGVLWVVRGAEGEAPSSSLATGLLRTIRSETDDDRPIVSLDLDASDPLAAASAAQSIFSAFRHGFMSPGGSAEVEYAERDGILRIPRVVESSLVNHEIVSSLRPAVAEDQPFFVSGRPLELTVGAPGRLDSLYYVDRSDISELPSDYVEIEVKAIGLGNGDVKTALGHDDAATPLGAECSGVVTALGDAVSGFKIGDRVAGFGAGTVATLYRDQAARFQLIPDDMSFARAAALPVAYITAFFAVHALGQVSRGDRVLIQDAGTAAGQALLELCAYAGGDIIAVVDSPSQRAFLVGEYDLPASRILVGLRGRRLATSVMTLTRGCGVDAIFNFRGGEERQLCWSCVAPYGRFIDLGGGPSDLKDMPQLEMASRFSKNASFTALDFHYLVTQKPQAVHRIWSDVMALVRAKAIRGPPRLQLHSVSEVETALKQSQDGCDVEKVVIRAERDTKVQALPPPKGQLLRADASYVLVGGLGGIGRAMASWMIATGARHLIFVNRSGLRRNEARETVESLIGHGAHVAVYSCDVSDRDQVAQMVAASSKEMPPIRGVIQAAMILDDALFEKMSVDDFNTVLQPKWQGTWNLHGLLPRYMDFFIMLSSISGVIGNATQAAYAAGSTFLGAFAQYRSSLGLPAVTLDLGVITGIGALSEHEELLQGMQRQGFEGTREQTLMALIRSAIVSPRRTGDQAEIVTGLGTWREGVLLGNFDQPLFAHFRRQALGLRDATAEGPGDSVTESLRGCKTLDDALALVCAALIDRLASRLNTPPDNIDSQRAMSEYGVDSLVAVEMRNWIGKEMESTMPILELLANQSIEQLSEEIAQRSKVVKVSGSEE

SEQ ID NO: 193 - protein, 2451 aa, Artificial Sequence
  sequence variant 3 of ORF 20_9399
MVENVSSPSSPRTSSPSGSCTPTSATSVGSDAKSMPIAVVGMSFRGPRDAISVESLWRMIAEGREGWSKIPKSRWNNDAFYHPDHSRHGTINVEGGHFLEEDLARFDAPFFNMTNAEAAALDPQQRLLLESTFEAVENAGIPLDKMLGSKTSCFVGSNANDYVDMLFRDPEAIPMYQCTNAGQSGAITANRVSYFFDLRGPSVTVDTACSGSLVALHLACQSLRTGDAKMAIVSGVNTILSHYFMSTMSMMRFLSPDGRCYTFDERANGYARGEGVGCLLLKPLSDALRDNDTIRAVIRGTGSNQDGKTKGITLPNANAQQELIRDVYAAAGLDPLETEYVECHGTGTQAGDPLETGAVAKVFSPRRKDDRPLRIGSIKTNVGHLEGASGIAGVIKAVLTLENQCFLPNRNFKSINPRIPLTEWKLRIQLENERWETVGPHRVSVNSFGYGGSNAHAVLEDTKGYLKQRSLTGSGREVRALSHAVTDLEPVSTPGSGPERTRLFVLSSFDQASGQQQIDQLREYLEQNSQREDDQYLADLAYTLGERRSPFLWKTAMPASSVSSLVEGLKTRAKVSRAEKKKPTLGFIFTGQGAQWCGMGRELLATYPVFASSVDAIATYLKSLGAPFDVLEELVRDPKDSKINQPLYSQPICTAVQIALVDLLTFWGIRPASVTGHSSGELAGAYTAGALSMEHSMAAAYYRGVASQKLPRDNDQRGAMMAVGASKDAIQPRLDSLTVGTAVVACVNSPSSVTISGDASAVDELLGLLEKDQVFARKLAVDVAYHSHHMKAVADQYRTAMASAGVTAVQPESTEPRVEFFSSVTGEYASPADLGIEYWVANLLSQVKFADSVHRLCGETSASGRHRKTKTKAPKRSGANNKAKVHMLVEIGPHSTLAGPIRQILGALLNLERASITYASALLRKSSAVETTLTLASTLLMAGYPIDMAAINRPSDHKREGVLVDLPPYPWNHSGSYWAEPRKSKDYRNRGHPRNDLLGVLDTHSSPEEPRWRNYLRTSEIPWIKDHMIQSNVVYPAAGYLTMAVEAIGQRIGDNFKLHRISGVRLRDVTIEAALVISDDSEPEVMLSLDPQGRSKLVQAERWHEFHVLSHPNDNRWTEHCRGLICASVGTMDWDEGDRGAEAGLTAETERWIEEAEQLCSKDVDIPRFYARLTDRGLEYGETFANMTRARSASHVCVAEIEVADTSAVMPLGFQSPFMVHPSTLDSLFHPLFVALSSDERLQDPVVPVAIEEITIKHEMAKEAGHKFQVCATTEETGRDRILAAISVVDAQRARSGPALTVRGLTCQFLDRASGDVEGADQETRHAYELHWEADIDLLSSSDLRTLCAVGRPRDVGEKVASYVKLLGHKFPHLAILEVGAGQGELCIAVFRALAGGLNSIPSFQSYTLADTEPGLSETIATIADQFDGRADLIQYKELDISSDPLQQGFTAHSLDLILLPSRGVSATLRSKILKHAHQLLTPEGMLIVVDTRDLQEWWQALRESNFTDPEIANDSQSEVQADISVLVSKPQPQRRDQTPSDPPDVLVIAENQDSGVSIEQLQRDLADAHVPATVTDFAHADLEGKTCIVLSELTTSLLSHPDQHSFEALKRILVAGGRGVLWVVRGAVGPAPTSSLATGLLRTIRSETDDDRPIASLDLDDEHPLSPESAAQSIFSAFRDRFVTPGGSHEVEYAERDGGLRIPRVVESSLVNHEIVSSARPAVAEDQPFFQTGGPLELTVTRPGRLDSLYYVDRSSISELPSDYVEIEVKAIGLGNGDVKTALGHDDAATRLGLECSGVVTALGDAVSGFKIGDRVAGFSAGTVATRYRDQADFFQLIPDDMSFARAAALPVAYITAFFAVHVLGQVSRGDRVLIQDAGTAAGQALLELCALAGGDIIAVVDSPSQRAFLMGEYDLPASRILVGLRGRRLATSVMTKTRGCGVDAIFNFRGGEERRLCWSCVAPYGRFIDLGGGPSDLWDMPLLEMRSFFSKNASFTALDFHYLVTQKPEAVHRIWSDVMALVRAKAIRGPGRLQLHSVSEVGTALKQSQDGCDVEKVVIRAENPTIVQAAPPPQGDLLRADASYVLVGGLGGIGRAMASWMIADGARHLIFVNRSGLPRNPARETVESLGGHGAGVAVASCDVSDRDQVAQMVARSSKEHPPIRGVIQAAMILYDMAFEKMSVDDFSTVLQPKWQGTWNLHGLLPRYMDFFIMLSSISGRIGNATQAAYAAGSTFLGAFAQHRSSLGLPAVTLDLGVIDGIGYLSEHTILLTGMQRQGFVGTNEQTLMALIRSAIVSPRRTGSQSEIVTGLGTWREGVSLGNFAQPLFAHFRRQAEGLRDSTATGPITSVRESLRNCMTRDDAVALVCAHLIDRLAARLNTPVDNIDSQRAMSEYGVDSLVAVEMRNWIGKEMESTMPILELLANQSISQLSEAIAQRSKVVAVSGSEE

SEQ ID NO: 194 - protein, 2451 aa, Artificial Sequence
  sequence variant 4 of ORF 20_9399
MVENVSSPSSPRTPSPSGSCTPPSATLVTSDDKSMPIAVVGMSFRGPRDAISVESLWRMISEGREGWSKIPKSRWNLDAFYHPDHSRHGTINVEGGHFLEEDLARFDAPFFNMTNAEAAALDPQQRLLLESTFEAVENAGIPLDKMLGSKTSCFVGSFCGDYTLYFLRDPEAFESYQGTNAGQSLAITANRVSYHFDLRGPSVTVDTACSGSLVALHLACQSLRTGDAKMAIVSGVNTILSHYFMITMSMMRFLSPDGRCYTFDERANGYARGEGVGCLLLKPLSDALRDNDTIRAVIRGTGSNQDGKTSGITLPNANAQQELIRDVYANAGLDPLETEYVECHGTGTQAGDPLETGAVAKVFSPTRPDDRPLYIGSIKTNVGHLEGASGIAGVIKAVLTLENQCFLPNRNFKSINPRIPLDEGKLNIQLENERWETVGPHRVSVNSFGYGGSNAHAVLEDTKGYLDPHSLTGSFNRVRALPHAATDLVPVSDPGSGPERTRLFVLSSFDQASGQQQIDQLREYLHQNSRRPDLQYLADLAYTLGERRSPFSWKTAMPATSHSSLVEQLRTRAKVSAASDNKPTLGFIFTGQGAQWCGMGRELLAAYPVFASSVDAIATYLKSLGAPFDVVEELVRDDKDSKINQPVYSQPICTAVQIALVDLLTFWGIRPASVTGHSSGELAGAYTAGALSMEHSMAAAYYRGVASEDLARVSTQDGAMMAVGASKDAIQPRLDSTTTGRAVVACVNSPSSVTISGDASAVDELVGLLEKDQVFARKLAVDVAYHSHHMKAVADQYRTAMAAAGVREQQPEPTEPEVEFFSSVTGEKASLTVLGIEYWVANLLSQVKFADSVHRLCEETSSSGRPRKTKTKAPKRSGANNKAKVDMLVEIGPHSTLAGPIRQILKADSNLEQAAIEYASALLRKKSAVDTTLTLASTLLMAGYPIDMTAINRPLVHHRVGVLVDLPPYPWNHSGSYWAEPRLSKEYRNRERPRNDLLGVLDTHSSPDEPRWRNYLRTSEIPWIKDHMIQSNVVYPAAGYLTMAVEAIGQRISPNFKGHAICGERLRDVAIEAALVISDDSEPEVMLSLYPSGDSGLVDAERWDEFHVLSVTPDVRWTEHCRGTICAEVAAMTGIEDDRGAEAGLEAEQERWIEAAEELCLTDVDLPRFYAELTALGLVYGEFFANMTRARSASNVCLAEIAVADTVAVMPYGYQVPFVVHPSTLDSLFHPLFVALCSLENMQKPAVPVAIEEIKIKHGMHKEAGHKFQVFASTQEDGTDRIEAAISVFDAQRTTSGPALSVRGLRCQFLDRASVDEEGSEQATRLAYELHWEAHNDLLSSSDLATLCAVGRPRDVMEAVARYVKLLGHKYPALAILEVGAGQGELCIYVFRALAGEANSTLSFASYTLADTEPGLSETIATIADKFIERADLINYKELDISNDPLQQGFNNHSLDLILLPSRGVSATLRLKILKHAHQLLTPEGRLIVIDLRDLQEWEAALRESNFTDPERIHDLVAETAAITSVLVSRPQPEPRPTTPVTPPDVLVIAGNGDSPASINHLQRLLADFHVPATLGEFATSRPEESTCIVLSELTTSLLSHPDQHRFETLKRILVASGRGVLWVVRGATGPAPTSSLATGLLRTIRSETDDDRPIVSLDLDASHSLSFSEAAQFIGSAFRSRDLSPGGSHEFEYAERDGILRIPRVFESELVNHEIVSYNRPDVASDQRFHQPGDPLELDVGTPGRLDSLYYVDDSCISELPSDYVEIEVKAIGLGNGDVKVALGHDDAANRLGVECSGVVTALGDAVSGFKIGDRVAGFGKGTVATLYRDQAARFQLIPDDMSFARAAALPVAYITAFFAVQALGQVSRGDRVLIQDAGTAAGQALLELCAYAGGDIIAVVDSPSQRAFLVGEYDLPASRILVGLRGRRLATTVMTLTRGCGVDAIFNFRGGEERRLCWSCVAPYGRFIDLGGGPSDLEEMDTLEMASFFSKNASFTALDFHQLVTQKPQYVHRIWSDVMRLVRAKVIRGPPRLQLHSVSEVETALKQSQDGCDVEKVVIRAERSTVVQALPPQKGDKLRADASYVLVGGLGGIGRAMASWMIANGARHLIFVNRSGNARNEARNTVESLEAHGAHVTFYSCDVSDRDQVSQMVAQSSKEFPPIRGVIQAAMILRDMLFDKMSFDDFDTVLQPKWMGTWNLHGLLPRDMDSFIMLSSISGHIGNATQAAYAAGSTFLGAFAQYRSSDGLPAVTLDLGVITGIGYLSEHEELKQGMERQGFPGTNEQTLMALILVAIVSPRRTFSQLEIVTGLDTWDEGGPLGIFDQPLFAHFRRPARPLRDRTAEGPGTSVAESLRGCETLDDAVALVCAWLIDRLASRLNTPVDNIDSQRAMSEYGVDSLVAVEMRNWIGKEMESTMPILELLANQSISQLSEKIAQRSKVVAVSGSEE

SEQ ID NO: 195 - protein, 2451 aa, Artificial Sequence
  sequence variant 5 of ORF 20_9399
MVENVSSPSSPRTSSPSTSCNPTSATSVGADDKSMPIAVVGMSFRGPRDARSVESLWRMISEGREGWSKIPPSRWNNDAFYHPDHERPGTITVEQGHFLPEDLADFDAEFFNMTNAEARALDPQQRLLLESTFEAVENAGIPLRSMPGSKTSCFVGSFCYDYTDMLSRDPEAIPEYQCTNAGQSRAITANRVSYEFDLRGPSVTVDTACSGSLVALHLACQSLRTGDAKMAIVSGVNTILSHEFMSGMSMMRFLSPDGRCYTFDERANGYARGEGVGCLLLKPLSDALRDNDTIRAVIRGTGSNQDGKTSGITLPNANAQQELIRDVYAAAGLDPLETEYVECHGTGTQAGDPLETGAVRKVFSRGRPDDRPLTIGSIKTNVGHLEGASGIAGVIKAVLTLENQCFLPNRNFKSINPRIPLKAWKLKIQLELERWETVGPHRVSVNSFGYGGSNAHAVLEDTKGVEEQRSLNGSFERVRALPAHATDSTPVSDPGSGPERTRLFVLSSFDQASGQQQIDQLREYLEQVSSRDDDLYLADLAYTLGERRSPFLWKTAMPASSVSSLKEGLRTRVVVSQGEEKKPTLGFIFTGQGAQWCGMGRELLAAYPVFASSVDAIATYLRSLGAPFDVREELVRDPKDSPINQPLYSQPICTAVQIALVDLLTFWGIRPASVTGHSSGELAGAYTAGALSMEHSMAAAYYRGVASADLPRERTQRGAMMAVGASKDAIQPRLSSWTSGEAVVACVNSPSSVTISGDASAVDELHGLLEKDQVFARKLAVDVAYHSHHMKAVADQYRTAMAAAGVTAVSPESTEPEVEFFSSVTGEKASETDLGIEYWVANLLSQVKFADSVHRLHEGYKDKGRKRKTKTKAPKRSGARNKNKVDMLVEIGPHSTLAGPIRQILGDDTTLEQASIRYASALLRKSSAVATTLTLASTLLMAGYPIDMAAIDRPSDPPKLSVLVDLPPYPWNHSGSYWAEPRLSLAYRNRAKPRNDLLGVLDTESSPREPRWRNYLRTSEEPWIKDHMIQSSVVYPAAGYLTMAVEAIGQRISENDAGFLISPYRLRDVAIEAALVISDDSEPEVMLSLRPSRDAGLVSDERWHEFHVLSVTGDDRWTEHCRGLICATVAAMDSDEADAGAEAGHTAEEERWIEEAFQLCQKDVDIPRFYAELTGLGLQYGESFANMTRARSASHVCLAEITVADTETVMPLGFESGFVVHPSTLDSLFHPLFVALSSDQSGQDPFVPVAIEEIYIRHNMAEEGGHKFQVCASTSESGDDRVQAAISVMDFQRASSGPALTVRGLTCQFLDRASGDPEGDEAVSRLAYRLIWTADVDLGSSSDLATLCAVGRPRDVGEIVAAYVKLLGHKNPHLAILEVGAGQGELCKPVFRRLTGEANSTRSFQSYTLADTEPGLSETIATIADKFDDRARRIEYKELDISHDPLQQGFNAHSLDLILLPGRGVSATLRSQILKHAHQLLTPEGRLIVGDTRDLQDWDQALLESNFTDPEVIHDSDGETAAAISVLVSKPQPQPRAQTPHGDPDILVIAINQTSGGRIEGLQRLLADAHIVAHVTRFAHALPEGKTCIVLSELTQSLLSHPDQHSFHALKSILVAGGKSVLWVVRGATGPAPTASLATGLLRTIRSETDDDRPIVSLDLDASHNLSAEQAAQLIKSAFRHRGVESGSSEEVEYAERDGILRIPRVVELSLVNHVIVSSLRLAPAEDQPLLQPGRPLELTVGTPGMLDSLAYVDDSCISELPSDYVEIEVKAIGLGNGDVKTALGHDDAATWLGAECSGVVTALGDAVSGFKIGDRVAGFVSGTVATLYRDQADRFQLIPDDMSFARAAALPVAYITAFFAVHALGQVSRGDRVLIQDAGTAAGQALLELCALAGGDIIAVVDSPSQRAFLRGEYDLPASRILVGLRGRRLATQVMTLTRGCGVDAIFNFRGGEERRLCWSCVAPYGRFIDLGGGPSDLTSMPQLEMGSFFEKNASFTALDFHLLVTQKPDAVHRIWSDVEQLVAAKAIRGPPRLQLHSVSEVETALKFSQDGCDVEKVVIRAERDTIVRALPRPKGVLLRADASYVLVGGLGGIGRAMASKMIANGARHLIFVNRSGLAHNGARETVESLEGAGADVALYSCDVSDRDQVAQMVAQSSKGMPPIRGVIQAAMILRDMLFEKMSVDDFNTVLQPKWAGTWNLHGLLPRDMDFFIMLSSISGVYGGATQAAYAAGSTFLGAFAQYRSSAGLPAVTLDLGVITGIGYLSEAGELSQGMQRTGANSTNEQTLMALIRQAIVRPRRTGFQAEIVTGLGTWRPVTSLGGSMQPLFAGFYREQLIQRDSTAEGPGTSVRESLRGCSTLDDAVALVTAALIDRLASRLNTPVDNIDSQRAMSEYGVDSLVAVEMRNWIGKEMESTMPILELLAPQSISQLSEKIAQRSKVVNVSGSEE

SEQ ID NO: 196 - protein, 2446 aa, Artificial Sequence
  sequence variant 6 of ORF 20_9399
MVENVSSPSSPRTSSPSGSCTPTSATSVGSDDKSMPIAVVGMSFRGPRDAISVESLWRMISEGREGWSKIPKSRWNNDAFYHPDHSRHGTINVEGGHFLEEDLARFDAPFFNMTNAEAAALDPQQRLLLESTFEAVENAGIPLDKMLGSKTSCFVGSFCGDYTDMLVRDPEAIPMYQCTNAGQSRAITANRVSYFFDLRGPSVTVDTACSGSLVALHLACQSLRTGDAKMAIVSGVNTILSHEFMSTMSMMRFLSPDGRCYTFDERANGYARGEGVGCLLLKPLSDALRDNDTIRAVIRGTGSNQDGKTSGITLPNANAQQELIRDVYAAAGLDPLETEYVECHGTGTQAGDPLETGAVAKVFSPGRPDDRPLRIGSIKTNVGHLEGASGIAGVIKAVLTLENQCFLPNRNFKSINPRIPLKEWKLKIQLENERWETVGPHRVSVNSFGYGGSNAHAVLEDTKGYLEQRSLTGSFRRVRALPHAATDLEPVSDPGSGPERTRLFVLSSFDQASGQQQIDQLREYLEQNSSRIDDQYLADLAYTLGERRSPFLWKTAMPASSVSSLVEGLKTRAKVSRAEKKKPTLGFIFTGQGAQWCGMGRELLAAYPVFASSVDAIATYLKSLGAPFDVREELVRDPKDSKINQPLYSQPICTAVQIALVDLLTFWGIRPASVTGHSSGELAGAYTAGALSMEHSMAAAYYRGVASSDLPRDHTQRGAMMAVGASKDAIQPRLSSLTTGTAVVACVNSPSSVTISGDASAVDELHGLLEKDQVFARKLAVDVAYHSHHMKAVADQYRTAMAAAGVTAVQPESTEPEVEFFSSVTGEKASLTDLGIEYWVANLLSQVKFADSVHRLCMETSASGRARKTKTKAPKRSGANNKAKVDMLVEIGPHSTLAGPIRQILGADQTLEQASIRYASALLRKSSAVDTTLTLASTLLMAGYPIDMAAINRPSDHHRVGVLVDLPPYPWNHSGSYWAEPRLSKAYRNRAHPRNDLLGVLDTHSSPREPRWRNYLRTSEIPWIKDHMIQSNVVYPAAGYLTMAVEAIGQRIGDNFPGHRISGYRLRDVAIEAALVISDDSEPEVMLSLRPSGDSGLVPAERWHEFHVLSVTPDNRWTEHCRGLICAEVAAMDGDEDDRGAEAGLTAETERWIEEAEQLCQKDVDIPRFYAELTGLGLEYGETFANMTRARSASHVCLAEIEVADTAAVMPLGFQSPFVVHPSTLDSLFHPLFVALSSDESLQDPAVPVAIEEIWIRHGMAKEAGHKFQVCASTQETGRDRIQAAISVVDAQRARSGPALTVRGLTCQFLDRASGDVEGDEQPTRLAYELHWEADVDLLSSSDLATLCAVGRPRDVGEKVARYVKLLGHKNPHLAILEVGAGQGELCIPVFRALAGEANSTPSFQSYTLADTEPGLSETIATIADQFDERADLIQYKELDISSDPLQQGFNAHSLDLILLPSRGVSATLRSKILKHAHQLLTPEGRLIVVDTRDLQEWWQALRESNFTDPEVIHDSPSETEADISVLVSKPQPQPRDQTPSDPPDVLVIAENQDSGVSIEHLQRLLADAHVPATVTDFAHADPEGKTCIVLSELTTSLLSHPDQHSFETLKRILVAGGRGVLWVVRGATGPAPTSSLATGLLRTIRSETDDDRPIVSLDLDASHPLSAESAAQSIFSAFRHRFVSPGGSHEVEYAERDGILRIPRVVESSLVNHEIVSSLRPAVAEDQPFFQPGRPLELTVGTPGRLDSLYYVDRSCISELPSDYVEIEVKAIGLGNGDVKTALGHDDAATRLGAECSGVVTALGDAVSGFKIGDRVAGFGAGTVATLYRDQAARFQLIPDDMSFARAAALPVAYITAFFAVHALGQVSRGDRVLIQDAGTAAGQALLELCALAGGDIIAVVDSPSQRAFLVGEYDLPASRILVGLRGRRLATSVMTLTRGCGVDAIFNFRGGEERRLCWSCVAPYGRFIDLGGGPSDLTDMPQLEMASFFSKNASFTALDFHYLVTQKPQAVHRIWSDVMALVRAKAIRGPPRLQLHSVSEVETALKQSQDGCDVEKVVIRAERDTIVQAIPPPKGDLLRADASYVLVGGLGGIGRAMASWMIANGARHLIFVNRSGLARNEARETVESLEGHGAHVAVYSCDVSDRDQVAQMVAQSSKEMPPIRGVIQAAMILRKMSVDDFNTVLQPKWQGTWNLHGLLPRDMDFFIMLSSISGVIGNATQAAYAAGSTFLGAFAQYRSSLGLPAVTLDLGVITGIGYLSEHEELLQGMQRQGFEGTNEQTLMALIRSAIVSPRRTGSQAEIVTGLGTWREGVSLGNFDQPLFAHFRRQALGLRDATAEGPGTSVRESLRGCKTLDDAVALVCAALIDRLASRLNTPVDNIDSQRAMSEYGVDSLVAVEMRNWIGKEMESTMPILELLANQSISQLSEKIAQRSKVVAVSGSEE

SEQ ID NO: 197 - protein, 2446 aa, Artificial Sequence
  sequence variant 7 of ORF 20_9399
MVENVSSPSSPRTSSPSGSPTPTSAGSVGSDPSSMPIAVVGMSFRGPRDAISVESLWRMIVEGREGWSKIPKSRWNWDAFYHPDHSRHGTINVEGGHFLTEDLARFDAPFFNMTNAEAAALDPQQRLLLESTFEAVENAGIPLDKMRGSKTSCFVGSFMSDYTLMKVRDPEAIPPYQCTNAGQSRAITANRVSYAFDLRGPSVTVDTACSGSLVALHLACQSLRTGDAKMAIVSGVNTILSHEFMSTMSMMRFLSPDGRCYTFDERANGYARGEGVGCLLLKPLSDALRDNDTIRAVIRGTGSNQDGKTSGITLPNADAQQELIRDVYAAAGLDPLETEYVECHGTGTQAGDPLETGAVAKVFSPGRPDDRPLRIGSIKTNVGHLEGASGIAGVIKAVLTLENQCFLPNRNFKSINPEIPLKEWKLFIQLENERWETVGPHRVSVNSFGYGGSNAHAVLEDTKGYLEQRSATGSFRRDRALPHVATDLEPVSDAGVGSERLRLFVLSSFDQASGQQQIDQLREYLEQNSSRIDDQYLADLAYTLGERRSPFLWKTAMPASSVSSLVEGLKTRASVSSAEKKKPTLGFIFTGQGAQWCGMGRELLAAYPVFASSVDAIATYLKHLGAPFDVREELVRDPKDSKINQPLYSQPICTAVQIALVDLLTFWGIRPASVTGHSSGELAGAYTAGALSMEHSMAAAYYRGVASSDLPRQHTQRGAMMAVGASKDAIQPRLSSLTPGTAVVACVNSPSSVTISGDASAVDELHGLLEKDQVFARKLAVDVAYHSHHMKAVADQYRTAMAAAGVTAPQPESTEPRVEFFSSVTGELASLTDLGIEYWVANLLSQVKFADSVHRLCMETSASKVTRKTKTKAPKRSGANNKAKITMLVEIGPHSTLAGPIRQILGAPQTLEQKSIRYASALLRKSSAVQTTLTLASTLLMAGYPIDMAAINRASDHHEVGVLVDLPPYPWNHSGSYWAEPRLSVAYRNRTDPRNDLLGVLDGHSSRREHRWRNYLRTSEIPWIKDHMIFSNVVYPAAGYLTMAVEAIGQRIGDNFTGHRICGYRLRDVAIEAALVISDESEPEVMLSLRPSGKSGLVPAERWHEFHVLSVTPDNRWTEHCRGLICEEVAAMDADEVDRGAEAGLTAETERWIEEAEQLCQKDVDIPRFYAELTGQGLEYGEAFANMTRARSASHVCVAEIEVADTASVMPLGFQKPFVVHPSTLDSLFHPLFVAFSSDESFQDPAVPVAIEEIWIRHGIAKEAGHKFQVCASTQETGRDRIQAAITVNDAQRTRSGPALTVRGLTCQFLDRASGDAEGDEQPTRLAYELHWEADVDLLSSSDLATLCAVGRPRDVGEMVARYVKLLGHKNPHLAILEVGAGQGELCRPVFRALAGEANSTKSFQSYTLADTEPGLSETIATIADQFDARADGIQYKELDISSDPLQQGFNAHSLDLILLPSRGVSATLRSKILKHAHQLLTPEGRLIVVDTHDLQEWWQALRESNFTDPEVIHDDPGTNEAPISVLVSKPLPQNRDQTPSDPPDVLVIAENQDSGVSIEHLQRLLADAHLPATVTDFAHADPEGKTCIVLSELTTSLLSHPDQHSFERLKTILVAGGRGVLWVVRGATGPAPTSSLATGLLRTIRSEHDDDRPIVSLDLDASHPLSAESAAQLIFSAFRHSFESPEGIHEHEYAERDGILNIPRVVESSLVNHEIVSSLRPAEAVDQSFFQPGRSLELTVGTPGRLDSLYYVDRSCIRELPSDYVEIEVKAIGLGNGDVKTALGHDDSGPRLGAECSGVVTALGDAVSGFKIGDRVAGFGAGTVATLYRDQASSFQLIPDDMSFARAAALPVAYITAFFAVHALGQVSRGDRVLIQDAGTAAGQALLELCALAGGDIIAVVDSPSQRAFLVGEYDLPASRILVGLRGRRLATSVMTLTRGCGVDAIFNFRGGEERRLCWSCVAPYGRFIDLGGGPSDLTDMPQLEMASFFSKNASFTALDFHYLVTQKPQAVHRIWSDVRALVRAKAIRGPPRLQLHSVSEVETALKQSQDGCDVEKVVIRAEADDIVQAIPPPKGDLLRADASYVLVGGLGGIGRAMASWMIANGARHLIFVNRSGLARNEARETVESLEGHGAHVVVYSCDVSDEDQVAQMVAQSSKEMPPIRGVIQAAMILRKMSVDDFNTVLQPKWQGTWNLHGLLPRDMDHFIMLSSISGVIGNATQAAYAAGSTFLGAFAQYRSSLGLPAVTLDLGVITGIGYLSEHPEKLQGMQRQGYEVTNEQTLMALIDYAIVSPRRTGSQAHIVTGLGTWRELVSLGNFDQPLFAHFRRQALGKTDATAEGPGASVRESLRGCKTLDDAVATVCAALIDRLAERLNTPVDNIDSQRAMSEYGVDSLVAVEMRNWIDKEMESTMPILELLANQSISQLSEKIAQRSSVVAVSGSEE

SEQ ID NO: 198 - protein, 2446 aa, Artificial Sequence
  sequence variant 8 of ORF 20_9399
MVENVSSPSSPRTSSPSGSCTPTSATSVASDVKNMPIAVVGMSFRGPRDAISVESLWRMISEGREGWSKIPKSRWNIDAFYHPDHSRHGTINVEGGHFLEEDLARFDAPFFNMTNAEAAALDPQQRLLLESTFEAVENAGIPLDKMLGSKTSCFVGSFCGDYTDILVRDPEAIPIYQCTNAGQSRAITANRVSYFFDLRGPSVTVDTACSGSLVALHLACQSLRTGDAKMAIVSGVNTILSHEFMSTMSMMRFLSPDGRCYTFDERANGYARGEGVGCLLLKPLSDALRDNDTIRAVIRGTGSNQDGKTSGITLPNANAQQELIRDVYAAAGLDPLETEYVECHGTGTQAGDPLETGAVAKVFSPGRPDDNPLRIGSIKTNVGHLEGASGIAGVIKAVLTLENQCFLPNRNFKSINPRIPLKEWKLEIQLENERWETVGPHRVSVNSFGYGGSNAHAVLEDTKGYLPQPSLTGSHRRVRRLPHAATDETPVSDPGSSPERTRLFVLSSFDQASGQQQIDQLREYLEQSSPSIDDQYLADLAYTLGERRSPFDWKTAMPASSVSSLVEGLKTRKKVSRAEKKKPTLGFIFTGQGAQWCGMGRELLAAYPVFASSVDAIATYLKSLGAPFDVREELVRDTKDSKINQPLYSQPICTAVQIALVDLLTFWGIRPASVTGHSSGELAGAYTAGALSMEHSMAAAYYRGVASSDLPRDHTQTGAMMAVGASKDAIQPRLSSLTTGTAVVACVNSPSSVTISGDASAVDELHGLLEKDQVFARKLAVDVAYHSHHMKAVADQYRTAMAAAGVLAVQPESVEPEVEFFSSVTGEKASLTDLGIEYWVANLLSQVKFADSVHRLCMETSASGRARKTKTKAPKRSGANNKRKVDMLVEIGPHSTLAGPIRQILGGAGTLEQASIRYASALLRKSSAVQTTLTLASTLLMAGYPIDMAAINRPSDHGRVGVLVDLPPYPWNHSGSYWAEPRGSKASRNRAHPRNDLLGVLDTTSSPREPRWRNYLRTSERPWIKDHMIQSNVVYPAAGYLTMAVEAIGQRIVDNFPGHRISCYYLRDVAIEAALVISDDSEPEVMLVLRPSPDSGLVPADRKHEFHVLSVTPDNRWTEHCRGLICAEVAAMDGDTDDRGAEAGLTPETERWIEEAEQLCQRDVDIPRFYAELTGLGLEYGETFANMTRARSADHVCLAEIEVADGAAVDPLGFQSPFVVHPSTLDSLFHPLFVALSSDESLVDPAVPVAIEEIWIRHGMCKEAGHDFQVCARTTETGKDRLQAAISVTDAQRARSGPALEVRGLTCQFLDRASADVEHDEQPTRLAYRLHWKADVDFLSSSQLATLCIVGRPRDVGEKVAGYVDLLGHKNPHLAILEVGAGQGELCIPVFRALAGRANSTPSFTSYTLADTEPGLSETIATIADQFDELADLIQYKELDISSDPLQQGFNEHSLDLILLPSRGVSATLREKILKHAHQLLTPEGRLIVVDTRDLQEWWQSLVESNFTDPESAHDSENRTEMDISVLVSKPLPQPKDLTPEDPPDRLVIATNQDSGVRIEHLQRLLADAHVPAIVTDFAHADPESKTCIVLSELTTSLLSHPDQHSFSTLKRILVAGGRGVLWVVRGATDPAPTSSLATGLLRTIRSETDDDRPIVSLDLDASHGLSAESAAQIIFSAFRHAFVSPGGSHEVEYAERDGILRIPRVVESSLSNHEIVSELRPAKAEDQPFVQPGRPLELTVGTPGRLDSLKYQDRSCISELPSDYVEIEVKAIGLGNGDVKTALGHDDAACRLGAECSGVVTALGDAVSGFKIGDRVAGFGAGTVATPYRDQAHRFGLIPDDMSFARAAALPVAYITAFFAVHNLGQVSRGDRVLIQDAGTAAGQALLELCALAGGDIIAVVDSPSQRAFLVGEYDLPASRILVGLRGRRLATSVMTLTRGCGVDAIFNFRGGEERRLCWSCVAPYGRFIDLGGGPSDLTDMPQLEMASFFSKNASFTALDFHYLVTQKPQAVHRIWSDVLALVRAKAIRGPLRLQLHSVSEVETALKASQDGCDVEKVVIRAERDTIVQAIPPPKGDLLRADASYVLVGGLGGIGRAMASWMIANGARHLIFVNRSGLARNEARETVESLEGHGAHVAVYSCDVSDGDQVAQMVAQSSKEMPPIRGVIQAAMILRKMSVDDFNTVLQPKWQGTWNLHGLLHRDMDFFIMLSSISGVIGNATQAAYAAGSTFLGAFAQYRSSLGLPAVTLDLGVISGIGYLSETEELIQGMQRQGFEGTNEQTLMALIRSAIVSPARTGSQAEIVTGLGFWREGTSLLNFDQPLFAHFRRQDLILSEATAEEPGTSVRESLRGCKTLDDAVALVCAALIDRLAKRLNTPVDNIDSQRAMSEYGVDSLVAVEMRNWIGKEMESTMPILELLANQSIAQLSEKIAQRSKVVAQSGSEE

SEQ ID NO: 199 - protein, 2446 aa, Artificial Sequence
  sequence variant 9 of ORF 20_9399
MVENVSSPSSPRTSSPSGSCTPSSATAVGEDDKSMPIAVVGMSFRGPRDARSVESLWRMISEGREGWSKIPKSRWNDDAFYHPDHSRHGTINVEGGHFLEEDLARFDAPFFNMTNAEAEALDPQQRLLLESTFEAVENAGIPLPKMLGSKTSCFVGSFCSDYGLMLDRDPEAIPMYMCTTAGQSRAITANRVSYFFDLRGPSVTVDTACSGSLVALHLACQSLRTGDAKMAIVSGVNTILSHEAMSVMSMMRFLSPDGRCYTFDERANGYARGEGVGCLLLKPLSDALRDNDTIRAVIRGTGSNQDGKTSGITLPNANAQQELIRDVYAAAGLDPLETEYVECHGTGTQAGDPLETGAVAKVFSDGREDDRPLRIGSIKTNVGHLEGASGIAGVIKAVLTLENQCFLPNRNFKSINPRIPLKKWKLKIQLENTRWERVGPHRVSVNSFGYGGSNAHAVLEDTKGYLENRSLTGSSNRERALPHAATDLEPVSDPGGPPESTRLFVLSSFDQASGQQQIDQLREYLEQNSSRIDDQYLADLAYTLGERRSPFLWKTAMPASSVSSLVEGLKTRERVSRAEKKKPTLGFIFTGQGAQWCGMGRELLAAYPVFASSVDAIATYLQSLGAPFDVLEELVRDPKDSKINQPLYSQPICTAVQIALVDLLTFWGIRPASVTGHSSGELAGAYTAGALSMEHSMAAAYYRGVASSDLPRDHQQRGAMMAVGASKDAIQPRLSQLTTGTAVVACVNSPSSVTISGDTSAVDELHGLLEKDQVFARKLAVDVAYHSHHMKAVADQYRTAMAAAGVTAQQPESTEPGVEFFSSVTGAKASLADLGIEYWVANLLSQVKFADSVHRLLMMTAAESRARKTKTKAPKRSGANDKAKVDMLVEIGPHSTLAGPIRQILPADSTLEAALIRYASALLRKSSAVQTTLTLASQLLMAGYPIDMAAINPPHDHRRVKKLVDLPPYPWNHSGSYWFEPRASKALRNRAFPANDLLGVLDTESSPREPRWRNYLRTSETPWIKDHMIGSNVVYPAAGYLTMAVEAIGQLIGDNFPGHLIGGFRLRDVAIEAALVISDDSEPEVMLSLRPSGGSASVPAERWHEFHVLSVTPDNRWTEHCRGLICLAVADMDTDELERGAEAGLEAETERWIELAEQLCQKDVDGPRFYATLTGRGLEYGETFANMTRARSASHVCLAEITVADTAAVMPRGFQSPFNVHPSTLDSLFHPLFVALSSDEDLQDPAVPVAIEEIWIRHGVAKLAGHKFQVHASTQETGQTAIQAAISVVTAQRARSGPALTVRGLTCQFLDRASGDVEGDEFRTRDAYQLHWEAYPDLLSSAQLATLCAVGRPRDVGEKVAAYVKLLGHKNPHLAILEVGAGQGELCRPVFRALAGEANSTLSFQSYTLADTEPGLSETIATIADQFDDRADLIQYKELDISSDPLQQGFKGHSLDLILLPSRGVSATLRSKILTHAHQLLTPEGHLIVVDTCDHQEWNQALRESNFTDPEVIHDQHSDYLADISVLVSKPQPQPRDQTPSTENDVLVIAEDQDSGPSIEHLQRRLADAHVPATVTLFAHADPEGKTCIVLSELTTSLLSHPDQHSFQTLKRILVAGGRGVLWVVRGATGPAPTSSLATGLLRTIRLETDDDRPIVSLDLDASAPLEANSAAQSIFSAFGQEFVSPGGSHEVEYAERDGILMIPRVVEATLVNHEIVSQLRPAVAEDQPFFQPSYPLELTVGTPGRLDSLPYVDRSCQSELPSDYVEIEVKAIGLGNGDVKTALGHDDAAGSLGAECSGVVTALGDAVSGFKIGDRVAGFGPGTVATLYRDQAASFILIPDDMSFARAAALPVAYITAFFAVHALGQVSRGDRVLIQDAGTAAGQALLELCALAGGDIIAVVDSPSQRAFLVGKYDLPASRILVGLRGRRLATSVMTLTRGCGVDAIFNFRGGEERRLCWSCVAPYGRFIDLGGGPSDLTEMPQLEMASFFSKNASFTALDFHSLVTQKPQAVHRIWSDVMALVVAKAIRGPPRLQLHSVSEVETALKFSQDGCDVEKVVIRAERDTIVQAIPPPSGYLLRADASYVLVGGLGGIGRAMASWMIAAGARHLIFVNRSGLARNEARETVESLEGHGAHVAVYSCDVSDRDQVAQMVALSSKRMPPIRGVIQAAMILRKMSLDDFTTVLQPKWQGTWNLHGLLGRDMDFFIMLSSISGVIGNATQAAYAAGSTFLGAFAQYRSSLGLPAVTLDLGVITGIGYLSEHEELLQAMERAGFEGTNEQTLMALIRLAIAQPRRTGSQAEIVTGLGRWRGDRSLGHPSQPLFAHFRRFALGLRDATAQGPGTSVRESLRGCKTLDDAVALVCAALIDRLASRLNTPVDNIDSQRAMSEYGVDSLVAVEMRNWIGKEMESTMPILELLANQSISQLSEKIAQRSKVVAVSGSEE

SEQ ID NO: 200 - protein, 2446 aa, Artificial Sequence
  sequence variant 10 of ORF 20_9399
MVENVSSPSSPRTVSPSGSCTPTSAQSTGSDDVQMPIAVVGMSFRGPRDAISVESLWRMISEGREGWSKIPKSRWNNDAFYHPDHNRHGTINVEGGHFLDEDLARFDAPFFNMTNAEAAALDPQQRLLLESTFEAVENAGIPLDKMLGSKTSCFVGSFCGDYTLVLVRDPENIPMYSCTFAGQGRAITANRVSYEFDLRGPSVTVDTACSGSLVALHLACQSLRTGDAKMAIVSGVNTILSHNMMSLMSMMRFLSPDGRCYTFDERANGYARGEGVGCLLLKPLSDALRDNDTIRAVIRGTGSNQDGKTSGITLPNAAAQQELIRDVYATAGLDPLETEYVECHGTGTQAGDPLETGAVAKVFSPGRPDDRPLLIGSIKTNVGHLEGASGIAGVIKAVLTLENQCFLPNRNFKSINPSIPLAEWKLKIQLEAERWEDVGPHRVSVNSFGYGGSNAHAVLEDTKNQLEQCSLSGSTRRERALSHAAQDTLANSDAGPEPSRTRLFVLSSFDQASGQQQIDQLREYLAQLSSRMDDQYLNDLAYTLGERRSPFLWKTAMPASSVSSLVEALKTTAAVSRAGKKKPTLGFIFTGQGAQWCGMGRELLATYPVFASSVDAIATYLKSLGAPFDVREELHRDPKASKINQPRYSQPICTAVQIALVDLLTFWGIRPASVTGHSSGELAGAYTAGALSMEHSMAAAYYRGVASSDLKRAHTQRGAMMAVGASKDAIQPRLQSFSTGTAVVACVNSPSSVTISGDPSAVDELHGLLEKDQVFARKLAVDVAYHSHHMKAVADQYRTAMAAAGVTILQVESTEPEVEFFSSVTGENASLADLGIEYWVANLLSQVKFADSVHRLLDETQDSGRARKTKTKAPKRSGAVNKAKVLMLVEIGPHSTLAGPIRQILRAFSTLELASARYASALLRKSSALDTTLRLASTLLMAGYPIDMAAIFSPYDKGRVGVLVDLPPYPWNHSGSYWAEPRLSRAKRNRAIPRNDLLGVLDTGSSKNEPRWRNYLRTSEMPWIKDHMIQSNVVYPAAGYLTMAVEAIGQRIGDTFPGLRVSGYRLRDVAIEAALVISDTSEPEVMLSLHPSGDKGHNPAERWHEFHVLSVTPDGRWTEHCRGYIEAGYAAMPGAEDDRGAEAGLTFELERWIEEAEQPCAKPVDIPRFYAELTDVGLEYGETFANMTRARSASRRCLAEIEVADTAAVAPLGFQQPFNVHPSTLDSLFHPLFVALFSDGSLQRPAVPVAIEEIWIRHGVATLMGHKFQVRASTQPSGRDTVQAAILVVDAQRARSGPALTVRGLTCQFLDRASGDVEGDEQLTRKAYNLDWEAKVELISSSDLATLCAVGRPRDVGLKVAKYVKLLGHKNPHLAILEVGAGQGELCLPVFPALGGDAASTPSFHDYTLADTEPGLSEAIATIADQFDERADGIQYKELDISSDPLQQGFNAHSLDLILLPSRGVSATLRNKILKHAHQLLTPEGFLIVVDARDSQEWWQALRESNFTDPESPHDSPSEDSLDKSVLVSKPQSQNRLQTPSTPLDVLVIAENQDSVRSIEMLQRLLADAHVPATVTDFNHADLTGKTCIVLSELTTSLLSHPDQHSFEALKRILVKGGKGVLWVVRGATVPAPTQSLATGLLRTIRSETDDDRPIVSLDLDAEHELSTSAAAQVILSAFMHRFESPTISHEVEYAERDGILRIPRVVEDSLVNAEIVSNAQPALAEDSPFFPPGYPLELTVRRPGRLDSLQYVDRSCISELPSDYVEIEVKAIGLGNGDVKTALGHDDATTRLGAECSGVVTALGDAVSGFKIGDRVAGFGAGTVATLYRDQAARFVLIPDDMSFARAAALPVAYITAFFAVHALGQVSRGDRVLIQDAGTAAGQALLELCALAGGDIIAVVDSPSQRAFLVGEYDLPASRILVGLRGRRLATSVMTLTRGCGVDAIFNFRGGEERQLCWSCVAPYGRFIDLGGGPSDLTDMPTLEMAYFFSKNASFTALDFNLLVTRKPQAVHRIWSDVMALVRDKAIRGPPRLQLHSVSEVETALKLSQDGCDVEKVVIRAERDTIVQAAPVPKGDLLRADASYVLVGGLGGIGRAMASWMIANGARHLIFVNRSGDAHNEARETVESLEGHGAHVAVYSCDVSDHDQVAQMVARSSKHMPPIRGVIQAAMILRKMSPDDFNTVLQPKWQGTWNLHGLLLRDMDRFIMLSSISGVMGAATQAAYAAGSTFLGAFAQYRSSSGLPAVTLDLGVITGIGYLSEHSELLQHMQRFGFVGTNEQTLMALIQAAIDSPRWTSAQDAIVTGLGTWREGKQLGNFDQPLFAHFRRAALLLPDATAEGPGESVLESLRGCKTLDDAVAFVCATLIDRLASRLNTPPDNIDSQRAMSEYGVDSLVAVEMRNWIFKEMESTMPILELLAAQSINQLSEKIAQRSNQVAVSGSEE

SEQ ID NO: 201 - protein, 2446 aa, Artificial Sequence
  sequence variant 11 of ORF 20_9399
MVENVSSPSSPRTTSPSGSCRPTSATSVGSDDKSMPIAVVGMSFRGPRDARSVESLWRMISEGREGWSKIPKSRWNNDAFYHPDHSRHGTINVEGGHFLDEDLADFDAPFFNMTNAEARALDPQQRLLLESTFEAVENAGIPLAKMLGSKTSCFVGSSCGDYADILVQDPEADRMYQVTAAGQSKAITANRVSYFFDLRGPSVTVDTACSGSLVALHLACQSLRTGDAKMAIVSGVNTILSHECFSGMSMMRFLSPDGRCYTFDERANGYARGEGVGCLLLKPLSDALRDNDTIRAVIRGTGSNQDGKTSGITLPNANAQQELIRDVYAAAGLDPLETEYVECHGTGTQAGDPLETGAVAKVFSPGRPDDRPLRIGSIKTNVGHLEGASGIAGVIKAVLTLENQCFLPNRNFKSINPRIPLKEWKLPIQLEHERWETVGPHRVSVNSFGYGGSNAHAVLEDTKGYLEERSLTGSFGSVRALPHHATDLELQSDPGEKPERTRLFVLSSFDQASGQQQIDQLREYLEQPSSRGDNQYLLDLAYTLGERRSPFAWKTAMPASSVSSLVEGLATRAKVSTSEKKKPTLGFIFTGQGAQWCGMGRELLAAYPVFASSVDAIATYLKSLGAPFDVPEELVRDPKDSKINQPLYSQPICTAVQIALVDLLTFWGIRPASVTGHSSGELAGAYTAGALSMEHSMAAAYYRGVASSDLPNKTTQRGAMMAVGASKDAIQPRLALFTNGTAVVACVNSPDSVTISGDASAVDELRGLLEKDQVFARKLAVDVAYHSHHMKAVADQYRTAMAAAGVTAVEPTSTEPEVEFFSSVTGQRATLERLGIEYWVANLLSQVKFADSVHHLCMHTIASGRFRKTKTKAPKRSGANNKEKVDMLVEIGPHSTLAGPIRQILTNDDSYEQRQIAYASALLRKSSAVDTTLTLASTLLMAGYPIDMAAINRPPPKHAVGSLVDLPPYPWNHSGSYWDEPRLSKAYRNRAHPRNDLLGVLDSHSSPREPRWRNYLRTSEIPWIKDHMIQSEVVYPAAGYLTMAVEAIGQRIDDKDRGHRISGDRLRDVAIHAALVISDESEPEVMLSLRPSGDAGLVSAERWHEFHVHSVTEDHRWTEHCRGLICIEVAAMDTAELARGAEAGATAAPEDWIEEAETLCQTDVDRPRFYAYLTGAGLEYGETFANMTRARSASHVCLAEIEVADDALLMPAGFQQPFLVHPSTLDSLFHPLFVALPSDESLQEPGVPVAIEEIWIKHDDPNEAGHKFQVCASIQQAGRDRIQAAIRVVDAQRLASSPALTVRGLVCQFLSRASGDVEGDEHPKRHAYELHWEADPPLLSSSDLEEFCAVGRPRDVGEQVARYVELLGHKNPHLAILEVGAGQGELCIPVFRALAGEANSAPSFQSYTLADTEPGLSETIATIADQFDERAGLITYKELDISQDPIQQGFNAHSLDLILLPSRGVSATLRSKILRHAHQLLTPEGRLIVDDTRDLEEWWQALVESNFTDPEVFRDSPDETEAMISVLVSKPQPQPRAQTPSDPPDVLVIAENQTSNVSIEHLQRLLADPHSDATVAEFTAADPEGLTCIVLKELTTSLLDHPDQHSFETLKLILVAGARGVLWVVRGATGPAPNSSLATGLLRTIRSETDDERPIASLDLDASHDLSAQSAAQSIFHAFRHAFVCPTGSAEVEYAERDGILRIPRVEESSLVNHRIKSSLRTAEPEDQPFFQPGRHLELNVGTPGRLDSLYYVDRSCKSELPSDYVEIEVKAIGLGNGDVKTALGHDDAADRLGFECSGVVTALGDAVSGFKIGDRVAGFSAGTVATPYRDQAILFQLIPDDMSFARAAALPVAYITAFFAVHNLGQVSRGDRVLIQDAGTAAGQALLELCALAGGDIIAVVDSPSQRAFLVGEYDLPASRILVGLRGRRLATKVMTLTRGCGVDAIFNFRGGEERDLCWSCVAPYGRFIDLGGGPSDLTDMPQLEMASFFSDNASFTALDFHMLLTCKPQAVHRIWSDVWALVRAKAIRGPPRLQLHSVSEVETALKFSQDGCDVEKVVIRFEKTTIVQALPRPAGSALRADASYVLVGGLGGIGRAMASWMIANGARHLIFVNRSGLARNEARETVESLEGHGAHVAVRNCDVSDRDQVEQMVAQSSKEVPPIRGVIQAAMILRKMSVDDFTKVLQPKWKGTWNLHGLLPRDMDVFIMLSSISGVIGNATQAAYAAGSTFLGAFAQSRSKQGLPAVTLDLGVITGIGYLSEHEDALQRMAENGTTGTNEQTLMALIRFAIVQPRQAGSQTEIVTGLGTWRELVSKVTFPQPLFAHFLRQQLGRRKATAEGPPISVRTSLRGCKTKDDAVALVCAALIDRLASRLNTPVDNIDSQRAMKEYGVDSLVAVEMRNWITKEMESTMPILELLAYQSISQLSEKIAQRSKVVAESGSEE

SEQ ID NO: 202 - protein, 215 aa, Artificial Sequence
  sequence variant 1 of ORF 21_9399
MRPDLWLLLALVCLPLICAQTPPDYWPKTPRGLDVIFRDQQLIQPGQLVLPDDAIDPPVFGRQGASVRQSYLAVMIDVEVNHEGTATPLVHWLQPDLKVRDPFPGRLARLSDEDVPYVGPRPVKGPRHTYVLLLFEQPTTYAFPGCFSSTRPTSVDQRSGFNLAQFMHEAGLQEPIAASYFTARNEETPSAPPPRVTTTSLSTAPCATPTRFVWC

SEQ ID NO: 203 - protein, 215 aa, Artificial Sequence
  sequence variant 2 of ORF 21_9399
MRPDLWLLLALVCLPLIAAQTPPGYWPKTPGGLDVSFRDQLLIDPGQLVLPDDAIDPPRFGRQGLSVGQSYLAVMIDVEVNHEGTATPLVHWLQPDLKVRDPFTGTLARLSDEDVPYVGPRPVPGPRHTYVLLLFEQPTTYSFPECFSSVRPKSVDTRLGFNLAQFMHVAGLQEPIAASYFTARNEETPSAPPPRVTTTSLSTAPCATPTRFVWC

SEQ ID NO: 204 - protein, 215 aa, Artificial Sequence
  sequence variant 3 of ORF 21_9399
MRPDLWLLLALVCLPLIRAQTPPGYWPKTPRGLSVIFRDQSLIQPGQLVLPDDAIGKPVFTRQGASVFQSYLAVMIDVEVNHEGTATPLVHWLQPDLKVRDPFSGRLATLSTEDVPYVGPRPVPGPRHTYVLLLFEQPRTYRFPEARSSTRPESVDERSGFNLAQFMHRAGLQEPIAASYFTARNEETPSAPPPRVTTTSLSTAPCATPTRFVWC

SEQ ID NO: 205 - protein, 215 aa, Artificial Sequence
  sequence variant 4 of ORF 21_9399
MRPDLWLLLALVCLPLICAQTPPMYVPKTKRGLDVIFRDQQLIQPGHLVLPDDAHFPPVFSRGGLSVFQSYLAVMIDVEVNHEGTFTPLVHWLQPDLKVRDDFTGRLIRLSDEDVRYVGPRPVPGPRHTYVLLLFEQPDTYRVPEHFSSIRPNSGDTRGGFNLAQFMAVAGLQEPIAASYFTARNETTPSAPPPRVTTTSLSTAPCATPTRFVWC

SEQ ID NO: 206 - protein, 215 aa, Artificial Sequence
  sequence variant 5 of ORF 21_9399
MRPDLWLLLALVCLPLIAAQTPPGYWPKTQRQLDVIFRDRIVINPGQLVLPDDAMIPPVFGRQGLSVSQSYLAVMIDVEVNHEGKATPLVHWLQPDLKVRDPFTGRLAFPSVEDVPYVGPRPVRGPRHTYVLLLFEQPTTYRSPETFSSTNPDDGDTRSGFNLAQFMEAAGLQEPIAASYFTARNEETPSAPPPRVTTTSLSTAPCATPTRFVWC

SEQ ID NO: 207 - protein, 228 aa, Artificial Sequence
  sequence variant 1 of ORF 22_9399
MYQEVDSMIAQIVEDAGSLHRAVTQVEELTPKLVAASPSSEKVLVPILKQIAECKQLLSEWNKRIDSLGLSRAKGISAFRKRFKAVVDRSFFENVRSRLCFHREQLTLLLTTADAFFDGYLEQGGQTICRLEAIDPRLQCLQARLEQSINPQWQKTTYNPKKSRRYAYERQIPRITRLLELVGSGRGLYHAHERQTDIEEFPLRVIQTGLLLSEQKGKIMSTLLALED

SEQ ID NO: 208 - protein, 228 aa, Artificial Sequence
  sequence variant 2 of ORF 22_9399
MYQEVDSMIAQIVEDAGKLHRAVAQVEELTPKLVNASASSEKVLNPIKDQIAECKADLSSWNKRIDSLTLSRAKGISAFRKRFKATVDRSFFENVRSRLCFHREQLTLLLTTADAFFDGYLEQGGQTICRLEAIDPRLQCLQARLEQSYGPQSLKTTYNPKKSRREAYVRQIPRKTRLLELVGSGRGLYHAHERQTDIEEFPLRVRQTGLLLTEQKGKIMSTLLALED

SEQ ID NO: 209 - protein, 228 aa, Artificial Sequence
  sequence variant 3 of ORF 22_9399
MYQEVDSRIAQIVEGARLLHRAVAQVEEKLPKLVAASPSSEKVLVPIKKQIAELKADLSSWNKRIDSLGLSRAKGISWFRKRFKATVDRSFFENVRSRLCFHREQLTLLLTTADAFFDTYLEQGGQTICRLEAIDPRLQCLQARLEQSIAPQSAKTTYNPKKSRRLAYVRQIPESTRLLELVGSGRGLYHAHERQTDIEEFPLRVFQTGLLLTEQKGKIMSTLLALED

SEQ ID NO: 210 - protein, 228 aa, Artificial Sequence
  sequence variant 4 of ORF 22_9399
MYQEVDSEIAQIVQDAGSLNEAVAQVEELTPKLVALSPSSEKVLNPIKKQIALCKADLSIWNKRIDSLGVSRAKGISAFRKQFKATVDRSFFENVRSRLAFHREQLTLLLTTADAFFDLYLEQGGFSLCRLEAIDTRLQCLQARLEQSINGQMGKTTYNPKKSRRQALVRQIPPETRLLELVGSGRGLYHAHERQTDIEEFPLNVIQTGLLLFEQKGKIMSTLLALED

SEQ ID NO: 211 - protein, 228 aa, Artificial Sequence
  sequence variant 5 of ORF 22_9399
MYQEVDATIAQIHEDAGSLHRAVQQVEELTPKLRDQSTSSEKVLSYIKKQIAECKADLSSWNKRIDSLGTSRAKGISVFRKTFKATVDRSFFENVRSRLCFHREQLTLLLTTADAFFDGYLEQGGQAIERLEAIDTRLQCLQARLEQIFNPQSVKTTYNPKKSRRTAYVRAIPRKRRLLELVGSGRGLYHAHERQTDIEEFPLRGVQTGLLLTEQKGKIMSTLLALED

SEQ ID NO: 212 - protein, 455 aa, Artificial Sequence
  sequence variant 1 of ORF 23_9399
MYPDDEARKRVDTMYIVWTRNLKQCLTERLAAMLAAQHRGGIPISAVAYRDGAYNRCYRMTFREGPDAIVRLPILGKVALRREKVNDELCIMGYITRNTSIPLPKVLGSGICGVGPYMVMNFAEGSPLGDYLSAPLPDRTRRAVLEPEISISKLITAYREMARVLLELSRSRFSRIGAPTQNTDGAWSVYKRPLTYNINELLTYANFPPNDLHRGPFSTAEEYFVALAEDHLQHLRTQRNSAVDDEADAKKKYVARDLFRNIARNFSTAYNNRPFSLQCDDLRPSNVLVDSDLHITSVIDWEYCYAAPLEFTYCSPEWLLLAHPDSWENGFNDFFTLYMPRQEIFLEVLREKEAEAAAKSKVVDSCRLSEHMEQSIHNGSFWFCLAARSSFSFDEIYWEFIDQRYYGEFTSVEDRMALLSEEERAELGGLYHLKMEQEAERKLDEHRTLDEILAS

SEQ ID NO: 213 - protein, 455 aa, Artificial Sequence
  sequence variant 2 of ORF 23_9399
MYPDDEARKRVDTMYIVWTRTLKQCLTERLAAMLAAKHRGGIPIEAVAYRYGAYNRCYQMTFREGPDAIVRLPILGKVALRREKVDDELCIMGYITRNTSIPLPKVLGSGICAVGPYMVMNFAEGSPLGDYLSAPLPDRTRVAVLEPEISISKLLTAYREMARVLLELSRSRFSRIGAPTQNTDGAWSVYKRPLTVNINELLRYANFPPYDLHKGPFSTAEEYFLALAEDHLQHLRTQRNGAVDDEADCKQKYVARCLFREIARNFLTAYNNGPFSLTCDDLRPSNVLVDSDEHITSVIDWEYCYAAPLEFTYCSPWWLLLAHPDSWEPGFNDFFTQYEPRQKIFLEVLRECESEAAASSAVVDSPRLSEHMEQSIHNGQFWFCLAARSSPSFDDIYWEFIDQRYYGEFTLVEDRIALLSEEERAELGGLYHLKMEQEAERKLDEHRTLDEILAS

SEQ ID NO: 214 - protein, 455 aa, Artificial Sequence
  sequence variant 3 of ORF 23_9399
MYPDDEARKRVDTMYIVWTRNLKQCLTERLAAMLAAKHRGGIPIEAEKYRDGAYNRCYRMTFREGRDAIVRLPPLGAVALRREKVNDELCIMGYITRETSIPLPKVLGSGLCAVGPYMVMNFAEGKPLSDYLSAPLPDRTRVAVLEPEISISELKTAYDEMARVLLELSRSRFSNIGAPTIRTDGAWSVYKRPLAYNINQLGTYANVPPQDLHKGPFSTANEYFRALAKDHLQHLRTQRNTAFDDEADCKKKYVARCLFRNIAENFRTAYNNGPFSLFCDDLRPSNVLVDSDLHITSVIDWEYCYAAPLEFTYCSPWWLLLAHPDEWENGFNDFFTQYMPRQKIFLEVLRECEHTAANRSAVVDSPRLSEHMEQSIHNGSFWFLLAARSSFSFDDIYWEFIDQRYYGSFTGDEDRMALLSEEERAELGGLYHLKMEQEAERKLDEHRTLDEILAS

SEQ ID NO: 215 - protein, 455 aa, Artificial Sequence
  sequence variant 4 of ORF 23_9399
MYPDDEARKRVDTMYIAWTRNLNQCLTERLAAMLAAAHRGGSPIEAVAYRDGAYNRCYRMSFREGPDAIVRLPILGEVALRREKVEDELCIMGYITRNTSIPLPKVLGSGICAVGPYMVMNFAEGSPLNDYLSAPLQDRTRVAVLEPEISISKLKNAYKEMARVLLELSRSRFSRIGAPTYNTDGLWYVLKRPLTYNYNELLRYANYPNRILHRGPFMTANEYFLALAEDHLQHLRTQRNPAVDDQADLRKKYVARLLFRNIARNFSTAYNDGPFSLLCDDLRMSNVLVDSDLHITSVIDWEQCSAAPLEFTYCSPWWLLLAHPDSWENGFNDFFTQYMPRQDIFLEVLRECEDEAAARPPVVDEPRLSKYMEQSIHNGSFWFALAARSSFSFDSIYWEFIDQRYYGEFYSQEDRMLLLSAEERAELGTLYHLKMEQEAERKLDEHRTLDEILAS

SEQ ID NO: 216 - protein, 455 aa, Artificial Sequence
  sequence variant 5 of ORF 23_9399
MYPDDEARKRVDTMYIVWTDELKQALTERLAAMLAAKHRGGPPIEASAYRDGAYNRCYRMTFREGPAAIVRLPTLGKVLLRAEKVRDELCIMGYITTNTSIPLPKVLGSGICAVGPYMVMNFAEGSPLGDRLHAPLPDRTRVAVLEPEISISKLQNAYREMARVLLELSRSRFSRIGAPTQATDGASEVAKRPLTYNTEELSTYANSPPQDADKGPFSTATEYFLALAEDHLQHLRTQRNDAVDDEADPEEKYVARCLFRRIFRNFSTPYENGPFSLTCDDLRPSNVLVDSDDHITSVIDWEFCYAAPLEFTYCSPWWLLLALPDSWESGFDDFFTQYAPRQKIFLEVLRECEDEAAARSAVVDSGRLSEYMEQSIHNGSFWFCLAARSSGSFDAIYWEFIDQRYYGEFTDVEDRMLLLSEEERAELGGLYHLKMEQEAERKLDEHRTLDEILAS

SEQ ID NO: 217 - DNA, 523 bp, Paecilomyces divaricatus
gtcgggagaggctcttcagatcaattcactgcggacaatcttcgatcctggacggcgtggagaggcggaccaaagacaagacccatctccatcgatccaatctcatcctcgatggattaatatactccatccctttcgcacaggcggactgtttctccggtcgcagcagcagactgaatgaatgtccccagaaaagtcaccgcggcgcgatgcaaatcccaagccagccgacatgggggccatgtcgatccatctactagagtagtatctgttggggatgcaaagatacggcggggactttgatggccatgaatgacgactcagcatcgagggttcatcggcaaatcgacgagaactgagttcactcattcatcgcaggaccgggggtcgttctttgcggaaccggaagagcatcacatcacccgtgcctttgttcacgataccttttactctgttcatctgcgaaggtggcaagacagcaagcaaccacctccacctccaccaccttcaccacctcgttgat

SEQ ID NO: 218 - DNA, 333 bp, Paecilomyces divaricatus
atggggagaatatgactctaacaaatcatataaatgagagtaccaaatttactgttgtttcagccctgtatctgcagatcccctcatgcgataactataccgtagtcaagtagaatcctagatggggccgattcggactcgaaaaaagcctccgctgccaatataataggtggatgtgatagacgccggcaacggattctttacgccaattgcggtctctcgaactcgatcggcggggcgggcgctaacttatcagatagagataaatagtgcccaattctcccccgctttcttcttggagacaaactgacactccccctccccctcaacacc

SEQ ID NO: 219 - DNA, 544 bp, Paecilomyces divaricatus
ggcgaagcgcctcagggcagatgtcaacaatagatacactgcgggcgatacttggagctgttgatcgattctttatatagactagagtagggagcagtagtccaaggagccacgctgataacaggactcgtggtacatccccagagctgattcagttttccaatggaatacaatcaatggggcttgattatttgtgggtttctctacttttagtgggttggaatttaatcttctgccggtcaggggccgttgattcatttcggccaattaagtgtcttcaatcatccccagcttcggagggttttgatctcgtgcaatatcagaccgcgggaggttcctgttttaatcagttcttcttatctattttttttttttgtctctcaattgatgacttcatcgcttgagtaaaataaagtagtacttttctcgcttattttatgttaatctttcatgtcagatcgtatattgatattcactacacacaatctgcttctccgttaccgtatagacagatataaacaaatgggttgaccctgtatgcatc

SEQ ID NO: 220 - DNA, 316 bp, Paecilomyces divaricatus
gatcagtgtcaaccaagcggataagaagcggtccgccgcaatttataaatcctccgcggtgcatttcgtgcccgccacaaagctcgactccgtggggactttgaccatggctcaacacgacaacatgatgaaatcggccaattccaagcattttcgacgaaagctgcgatttcctccagccgggaccggcttgtggtcgacagataacagagtccaaccccccgagaagacgatatagattgcgggttctcacttcctcactcacgctcatctcccacgacaacttgaaccacacactctcacacactcagacatc

SEQ ID NO: 221 - DNA, 484 bp, Paecilomyces divaricatus
tttgctcactgattctttggtgggcaatggagttcaatggctggatactgcaatgataaggaatgctgtgtcgttacgaacttacgactataggacatgagcagaaaacccccgcgacggacgaagcatcattcaggcacagggcaggcttgaagattaagcatcagtttcacgtgcttgacaactaaggcgagtcatctacatttgatattccgaaagtgtaaagagaagtctttttgcacgggagagatctctgaattggtcactggacagaaagtcaccgcagcagaaacttgccgcaacccagggctcaggatgcggctctaacggcctccacctcacctcgtctgtccaggctgatgggctcattcagatcgattgactatataaccgcggaaactgtgcgcggtccagcattcgtctggaccagcatcttcctaccgggttcactacctccaccaccaccaccgacaccacattcaca

SEQ ID NO: 222 - DNA, 969 bp, Paecilomyces divaricatus
gctgcaaatggacgatagcaatagcggacagccagatcattcactgtctccatagtgtgtagtgtgtagataaggttgtggatatatatttggtggtgcagaagtcgccgtggaaagtgaccgattccccgctattatgcggacaataaagtgattcattccgactcttagaaatggttgcgtacataggtaacgtaaaagaaaagaagacaattataattaatgaagaaatggattaaatcagcatcaacgatttactacaatacaaacaggggcccggaagtttgtagctggccggataggaaaagttgcgggtgatatataaagcatgataataggtcttcacgaccggcagctttggttcatactggcacatatcctgtcttttagaatatcatgtagagctcttctgcgccatcaagtatgcagccacactacccgttgctcgaggatactgaatctctccttcaaacccattcgtatgatgtccattcagaaaatccccaagtgtatatctatgttatgagccatgagaggggcaacagccgaaaacctccctcatgatattgctcgaaaccgcaaactgagattgggaagcataacacatgaagcaatatcttcgctttgtactactgtcctcctactatcaataccaatcgcagttatgcaggtagacctgttctctgtagacgaggctgtgtcggagtcagcctggtctgcctgtgtcccgcagcagagtgtacacattaatagcctcgtcatcgcccaaagcatggccagtccaaaaggctaaatagaacagcaacgtcccagttccttatcttcttgaaagtatctagctcactttactgtacattcattctcatggccgggcggcgtaggcgaagccgcgagcatcgcaggcttcctcagccttgcggtgcggggcagacagccgcaggtgcgatcaaactctacaatttttgtaaa

SEQ ID NO: 223 - DNA, 358 bp, Aspergillus nidulans
caactgatattgaaggagcattttttgggcttggctggagctagtggaggtcaacaatgaatgcctattttggtttagtcgtccaggcggtgagcacaaaatttgtgtcgtttgacaagatggttcatttaggcaactggtcagatcagccccacttgtagcagtagcggcggcgctcgaagtgtgactcttattagcagacaggaacgaggacattattatcatctgctgcttggtgcacgataacttggtgcgtttgtcaagcaaggtaagtggacgacccggtcataccttcttaagttcgcccttcctccctttatttcagattcaatctgacttacctattctacctaagcat

SEQ ID NO: 224 - DNA, 7306 bp, Artificial Sequence
  plasmid pKO-PKS
ctaaattgtaagcgttaatattttgttaaaattcgcgttaaatttttgttaaatcagctcattttttaacgcatggctggggcaccaatatccaggttcgtgcgatgaccgaaagtaatccaatggctcgcgcctcgagtgactgaccataatttatctggcagatcttacagtcccaactcggtagacaccgcagccctacaaaagaaaaaacaaaaaaaaaccccctaaccgtgaacaggccccctaatgcgagagctgcagaaagacaacagcgcggaatttcatttcatccagggcgatgtcgaggcagatcccggcccaggtatcgagggcttctacgaagggccctactacagcttctaccaattcccccggactttccccgacagtgatgacgaggaggacgatggcggagatgcgtccatgttcgaggcctatgagatgatctacgacatcatagccgaggagggtccttttgacggcatcctcggcttctctcacggcggcaccttggcctcgggcttcctcatccatcacagtaagacctccccttatacgccgccccccttccgatgcgccgtgtttttcaattcactgccgccgttccgcatggatcccggcgaggagcttgtcgtggatgatgatctggcccggcacctcacgataccgaccctcagcattgcggggacgcgggactttgtctacaagcagtctctgatgctgcaccagttgtgcgatgagaagtcgtcgcagctgatcctgcatggaaagggccacgagatcccgggggatgcggcgacggtggcgcggatggctaaggcatttcgggcactgtgtttgcgggccatgtatttgtagattgttaataaatcgacccattgattcgatgtacagagctgtgaactgagaatctggatgaagcgctagtaatactattgaaatccgtatacaaagataaaaatgtaggatgactgcaggtggtagttaggagccacggacctggttaagaagataccaaattgtaggggtgaatagacctaaccctggctggctagtctaggtcagtactacagtttagacaggggcaaccaggcaaaatacaattaaaataatcaccattattaactattatctacgcaattactaatgacttaactggacttagagactgaggattctacaagatttcaagaaacaaacaaaaagacatcacatacgaacgccaaaatcactagtgctccgtcaaggttttcggtccacagccccgtaacccctcggcatttggaacaaaagtctccgagtaaaccaccccgactgttatgcatcactgttgtcaaacactccgaatgtgcaatcctgccaccggcgactattccccctcgcagcacggtcatataagtctacagaaaatgttccatatctcgatgatcgtgtatatatttcttcccagccaatcgtcactgactccacgaaagtgcccggacgttcctcatgtccgagtgaagaagtcaaagtcacagtcacggatgaacttgcttctcccatctgtgaatggatatcgtccaacgagctcatttaaatgaattcgaagttcctatactttctagagaataggaacttccgttaactgatattgaaggagcattttttgggcttggctggagctagtggaggtcaacaatgaatgcctattttggtttagtcgtccaggcggtgagcacaaaatttgtgtcgtttgacaagatggttcatttaggcaactggtcagatcagccccacttgtagcagtagcggcggcgctcgaagtgtgactcttattagcagacaggaacgaggacattattatcatctgctgcttggtgcacgataacttggtgcgtttgtcaagcaaggtaagtggacgacccggtcataccttcttaagttcgcccttcctccctttatttcagattcaatctgacttacctattctacctaagcattcatggccaccctcgatgacacggcttaccgctaccgtaccagcgtccccggcgacgccgaagccatcgaggccctggatggctctttcaccacggataccgtctttcgcgttaccgctaccggtgacggcttcacgctccgtgaggtgcccgtcgaccctcccctgaccaaggttttccctgatgacgaatctgacgatgaatccgacgatggcgaggacggcgatcccgactctcgcacgttcgtcgcttacggcgatgacggtgacctggccggctttgtcgttgtgtcctattccggttggaaccgtcgcctgaccgtcgaagacatcgaggttgcccccgagcatcgcggccacggtgtcggccgcgctctcatgggtctcgccacggagttcgcccgtgagcgcggcgccggtcacctctggctggaggttaccaatgtcaacgctcccgccattcacgcctaccgtcgcatgggctttaccctctgcggcctggataccgctctctacgatggcaccgcctccgatggcgagcaggccctctatatgagcatgccttgcccctgagaagttcctatactttctagagaataggaacttcgggcccatttaaatggtaccagtatgaattgcgatttggatggttttttagttcacatcagatgacggcattgtatttatttgaataaccagaatttgatatcattatttcccaggaagtggaagacaaaaggattcaaggatatctacaatttttgcgtcaaaaattgaatgcatcgtttccttggcggttattggcatactatcaaggtcatcccgctccaatccctaaaacccagtttcaatacgccaactctggagctttttttttttttttcttctagatagttaactgtcacatcctgggatttataagaactacataatgatcgttcccctagaacttctttcaatgataaaacagaaggaaaacaaaaaaagaaagaaacaatcggcacaatcatgaatcataacttttcatcccccctcaacaccagacaaatcgagtcggagtcgcacaaggcgcggtactcagcgaggttgtcgtcactctcggcggaggcgccgagggcgtctcttcgttccgagccgtgaaataactcgccgcaataggttcctgcaaccccgcgacgtgcatgaactgggccaggttgaagcccgagcgggtgtcgacgctgatcggccgggtgctcgagaagcattcggggaagcgatatgtcgtgggctgctcaaataaaaggagcacgtaggtatggcgagggccggggaccgggcgcgggccgacataggggacgtcctcatcactcaacctcgccagccggccggtgaagggatcgcggaccttcaggtcgggctgtagccagtgcaccaggggcgttgcggtgccttcgtggttgacttcgacgtcgatcatcacggcgaggtaggactggaacacactgagaccttgccgaccgaataccggggggtcgatggcatctacacgaatcagatattagtggggaaagctctgactggtcggaagaatatatcacattaccatcgggaaggactaattggcccggttgaatgagctgctggtcacgaaatatgacatccaggcccctcggggtctttggccagtatcctggtggcgtctgggcggcgatcaaggggaggcacaccaaggccagaagaagccacaagtctggacgcatgctgcaaatggacgatagcaatagcggacagccagatcattcactgtctccatagtgtgtagtgtgtagataaggttgtggatatatatttggtggtgcagaagtcgccgtggaaagtgaccgattccccgctattatgcggacaataaagtgattcattccgactcttagaaatggttgcgtacataggtaacgtaaaagaaaagaagacaattataattaatgaagaaatggattaaatcagcatcaacgatttactacaatacaaacaggggcccggaagtttgtagctggccggataggaaaagttgcgggtgatatataaagcatgataataggtcttcacgaccggcagctttggttcatactggcacatatcctgtctcgttaactgatattgaaggagcattttttgggcttggctggagctagtggaggtcaacaatgaatgcctattttggtttagtcgtccaggcggtgagcacaaaatttgtgtcgtttgacaagatggttcatttaggcaactggtcagatcagccccacttgtagcagtagcggcggcgctcgaagtgtgactcttattagcagacaggaacgaggacattattatcatctgctgcttggtgcacgataacttggtgcgtttgtcaagcaaggtaagtggacgacccggtcataccttcttaagttcgcccttcctccctttatttcagattcaatctgacttacctattctacccaagcatccaaatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagttcagcgagagcctgacctattgcatctcccgccgtgcacagggtgtcacgttgcaagacctgcctgaaaccgaactgcccgctgttctcgagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcatgcggatttcggctccaacaatgtcctgacggacaatggccgcataacagcggtcattgactggagcgaggcgatgttcggggattcccaatacgaggtcgccaacatcctcttctggaggccgtggttggcttgtatggagcagcagacgcgctacttcgagcggaggcatccggagcttgcaggatcgccgcgcctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 225 - DNA, 21 bp, Artificial Sequence
  KO_PKS_1 fw (MoA 550) primer
catggctggggcaccaatatc

SEQ ID NO: 226 - DNA, 20 bp, Artificial Sequence
  KO_PKS_1 rv (MoA 551) primer
cgacggtaggcgtgaatggc

SEQ ID NO: 227 - DNA, 28 bp, Artificial Sequence
  KO_PKS_2 fw (MoA 552) primer
ctgacttacctattctacctaagcattc

SEQ ID NO: 228 - DNA, 25 bp, Artificial Sequence
  KO_PKS_2 rv (MoA 553) primer
gacaggatatgtgccagtatgaacc

SEQ ID NO: 229 - DNA, 22 bp, Artificial Sequence
  Upstream 5flank fw (MoA 635) primer
caccacattcacaatgccggtg

SEQ ID NO: 230 - DNA, 28 bp, Artificial Sequence
  clonNAT rv (MoA 651) primer
ccatgaatgcttaggtagaataggtaag

SEQ ID NO: 231 - DNA, 24 bp, Artificial Sequence
  clonNAT fw (MoA 652) primer
cttgcccctgagaagttcctatac

SEQ ID NO: 232 - DNA, 26 bp, Artificial Sequence
  Downstream 3flank rv (MoA 638) primer
gcgcagaagagctctacatgatattc

SEQ ID NO: 233 - DNA, 22 bp, Artificial Sequence
  PKS fw (MoA 359) primer
ggcttcaacttcattccgtctc

SEQ ID NO: 234 - DNA, 18 bp, Artificial Sequence
  PKS rv (MoA 360) primer
ccgagatccagcgtcacg

SEQ ID NO: 235 - DNA, 8542 bp, Artificial Sequence
  plasmid pHOFF6
ctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggaggcgcggcgatcctgcaagctccggatgcctccgctcgaagtagcgcgtctgctgctccatacaagccaaccacggcctccagaagaggatgttggcgacctcgtattgggaatccccgaacatcgcctcgctccagtcaatgaccgctgttatgcggccattgtccgtcaggacattgttggagccgaaatccgcatgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatcgcctccgcgaccggctcgagaacagcgggcagttcggtttcaggcaggtcttgcaacgtgacaccctgtgcacggcgggagatgcaataggtcaggctctcgctgaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatttggatgcttgggtagaataggtaagtcagattgaatctgaaataaagggaggaagggcgaacttaagaaggtatgaccgggtcgtccacttaccttgcttgacaaacgcaccaagttatcgtgcaccaagcagcagatgataataatgtcctcgttcctgtctgctaataagagtcacacttcgagcgccgccgctactgctacaagtggggctgatctgaccagttgcctaaatgaaccatcttgtcaaacgacacaaattttgtgctcaccgcctggacgactaaaccaaaataggcattcattgttgacctccactagctccagccaagcccaaaaaatgctccttcaatatcagttaacgggcccgttaacgttaactggttcccggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggaggcgcggcgatcctgcaagctccggatgcctccgctcgaagtagcgcgtctgctgctccatacaagccaaccacggcctccagaagaggatgttggcgacctcgtattgggaatccccgaacatcgcctcgctccagtcaatgaccgctgttatgcggccattgtccgtcaggacattgttggagccgaaatccgcatgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatcgcctccgcgaccggctcgagaacagcgggcagttcggtttcaggcaggtcttgcaacgtgacaccctgtgcacggcgggagatgcaataggtcaggctctcgctgaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatttggatgcttgggtagaataggtaagtcagattgaatctgaaataaagggaggaagggcgaacttaagaaggtatgaccgggtcgtccacttaccttgcttgacaaacgcaccaagttatcgtgcaccaagcagcagatgataataatgtcctcgttcctgtctgctaataagagtcacacttcgagcgccgccgctactgctacaagtggggctgatctgaccagttgcctaaatgaaccatcttgtcaaacgacacaaattttgtgctcaccgcctggacgactaaaccaaaataggcattcattgttgacctccactagctccagccaagcccaaaaaatgctccttcaatatcagttaacgggcccgagctcgcggccgctgtattctatagtgtcacctaaatggccgcacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaacaataaaactgtctgcttacataaacagtaatacaaggggtgttatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagaattaattcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctaatacgactcactatagggaaagctcggtaccacgcatgctgcagacgcgttacgtatcggatccagaattcgtgattcacaggatcccaactgatattgaaggagcattttttgggcttggctggagctagtggaggtcaacaatgaatgcctattttggtttagtcgtccaggcggtgagcacaaaatttgtgtcgtttgacaagatggttcatttaggcaactggtcagatcagccccacttgtagcagtagcggcggcgctcgaagtgtgactcttattagcagacaggaacgaggacattattatcatctgctgcttggtgcacgataacttggtgcgtttgtcaagcaaggtaagtggacgacccggtcataccttcttaagttcgcccttcctccctttatttcagattcaatctgacttacctattctacctaagcatccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccgctctagaactagtggatccacttaacgttactgaaatcatcaaacagcttgacgaatctggatataagatcgttggtgtcgatgtcagctccggagttgagacaaatggtgttcaggatctcgataagatacgttcatttgtccaagcagcaaagagtgccttctagtgatttaatagctccatgtcaacaagaataaaacgcgtttcgggtttacctcttccagatacagctcatctgcaatgcattaatgcattggacctcgcaaccctagtacgcccttcaggctccggcgaagcagaagaatagcttagcagagtctattttcattttcgggagacgagatcaagcagatcaacggtcgtcaagagacctacgagactgaggaatccgctcttggctccacgcgactatatatttgtctctaattgtactttgacatgctcctcttctttactctgatagcttgactatgaaaattccgtcaccagcccctgggttcgcaaagataattgcactgtttcttccttgaactctcaagcctacaggacacacattcatcgtaggtataaacctcgaaaatcattcctactaagatgggtatacaatagtaaccatgcatggttgcctagtgaatgctccgtaacacccaatacgccggccgaaacttttttacaactctcctatgagtcgtttacccagaatgcacaggtacacttgtttagaggtaatccttctttctagaagtcctcgtgtactgtgtaagcgcccactccacatctccactcgacctgcaggcatcgagcctaggctagctctagaccacacgtgtgggggcccgttaacgttaactggttcccggtcggcatctact

SEQ ID NO: 236 - DNA, 955 bp, Paecilomyces divaricatus
ggacaattgtctctatcgtagatgtatcttgtaaagtcgtctgcgatgccttcgaggggcggagactctaaaagagaatcaagagataagaagattgaaaagtatcagatcgagaactacagaaagtgatgtgaacaatgagagcacaatcaaacacggaaggctgaatagcatggctgtcgatgtgactcgacagataaaatggtggtcatgaaggcatagaccgtaggacgagtggttgatacagaagaggagagccagcggtgagtcggcggtggcgtggacgtcggtgactcgacgggataagccctgctcaccgctttcctcttttgacgtcgccgagaacgctcgaccgatctggcaaggtctgatctcggccggagtaataaattatccgcaatcccaagtcatgtgatgcgccaaggcccttgcctgcttcaggttaggctgtggcttgcatctcagcagggaagcgccacagatctaaggatcatcgcgacgtcatggatggtgacatcgacgaggaagacgcgttcagtcttgtttctcaagccacaatgatccctgctggggtctggaacgtcagccaaggctccgatgtgatcaagcgcggggacacgaatctccactcttgattcaatggcactattttccagccctgatatccagtcgttcaagtgtggggacgctcaaggtaggataatgtaggataacgtacctaggataccagtttccttgtatgtatgtcctgcaagtaattactcgtgtatttaccatgtgctcctgaatcgacgtcatggactgagggagagatgtgaaatccgtggtatataaacctccacgatcttccagctttctgcatacaacagcaatctccatctcaaacacttaaccactctctcgaagataactactcttttcaaaccaaaacttcttcattcaaacaactgcaaac

SEQ ID NO: 237 - DNA, 390 bp, Paecilomyces divaricatus
atgtctgaccccggacgcaaggactggtctaccagtatgtgcttgaatcgatttcattcatgattcacgtgtctttgctaaaccaaatccttacagaggctaaggaggagatcactcctgactcttccaagtcgacccagcagaaggtgaaggagaccttcaccgataccaccgaccgcgtctcccgtggcgttcagcctgactcggacaagtctaccggccagtctgcattcgacaaggcccagcgcagccacgacaacgagtcgcacggcggtgcctctggatccatgtgagtctcatcccaaccgatgtcaaaaggtatacagtcatctgaccggtaattatagcggcgacaaggtcaagaacgccctaggtgttggcaacaactaa

SEQ ID NO: 238 - protein, 89 aa, Paecilomyces divaricatus
MSDPGRKDWSTKAKEEITPDSSKSTQQKVKETFTDTTDRVSRGVQPDSDKSTGQSAFDKAQRSHDNESHGGASGSIGDKVKNALGVGNN

SEQ ID NO: 239 - DNA, 9919 bp, Artificial Sequence
  plasmid pHOFF6 Phsp9-TF1
cccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctaatacgactcactatagggaaagctcggtaccacgcatgctgcagacgcgttacgtatcggatccagaattcgtgattcacaggatccggacaattgtctctatcgtagatgtatcttgtaaagtcgtctgcgatgccttcgaggggcggagactctaaaagagaatcaagagataagaagattgaaaagtatcagatcgagaactacagaaagtgatgtgaacaatgagagcacaatcaaacacggaaggctgaatagcatggctgtcgatgtgactcgacagataaaatggtggtcatgaaggcatagaccgtaggacgagtggttgatacagaagaggagagccagcggtgagtcggcggtggcgtggacgtcggtgactcgacgggataagccctgctcaccgctttcctcttttgacgtcgccgagaacgctcgaccgatctggcaaggtctgatctcggccggagtaataaattatccgcaatcccaagtcatgtgatgcgccaaggcccttgcctgcttcaggttaggctgtggcttgcatctcagcagggaagcgccacagatctaaggatcatcgcgacgtcatggatggtgacatcgacgaggaagacgcgttcagtcttgtttctcaagccacaatgatccctgctggggtctggaacgtcagccaaggctccgatgtgatcaagcgcggggacacgaatctccactcttgattcaatggcactattttccagccctgatatccagtcgttcaagtgtggggacgctcaaggtaggataatgtaggataacgtacctaggataccagtttccttgtatgtatgtcctgcaagtaattactcgtgtatttaccatgtgctcctgaatcgacgtcatggactgagggagagatgtgaaatccgtggtatataaacctccacgatcttccagctttctgcatacaacagcaatctccatctcaaacacttaaccactctctcgaagataactactcttttcaaaccaaaacttcttcattcaaacaactgcaaacatgccatcctcatccttcccacatccgcccagccctggcgaaacggcaagcaagcccggcgagccggtgaaactgcgctccacgtgtgacgcctgccagaaggccaaacatcggtgctcgcgcgaacagccgtgccaacactgcaagtacaacaaagttccctgcgtgtacagtgccctgcgacgcattggacgtccgccgcggcggaaaccccccggcgacgcggccgagagagagaagacccccaagaggagcaaaaaccgtgccttccagggcaacaacacggcgtccacacacgcctccgaaggcagtcccgccgagcctccattgcccccgacgacggcatccatctccatcagccaccgtgcggtcgattccttctcgtcttcctcctcatacgatcatgcctttctgctcgggcacggcccggccgccgccgccaggatggatgacgacgcctggctggagatggatggctcgaatcatgaccccgcgggggacccctcgggaccccccgcattcgatctggagtctatcctggacttcgacgggccgacgctgagcggaatgaccgccggtgcgtccatggcccccagtgaccagggcccctgtccgcccggcaccgagcccccatccttccttgaatcgttcaaatcggcggcggctccgatgggggatgccttcctgttcctcgagaaccctccgcccttcgagtcgtcggcgggccccggactgcctccgccggccccggaggagccaggggtcggctacccgatgtccatgccggcggacagccatcccgaggggtcggcgccgaggccgcagcgtctcccatcggcgccgccggcccggcactgcgaatgctatcagtcggtgctggccagcctgggggatttcgatcgccgcacctcgctgggactggcgtgctcgatcgacatgctcgtggccctggagcagagcgcccaccggcaggcggcgcaggtcctgcagtgccagggatgttccggcagtcgcccggacctcctcctgctggtggcgctgaagatcgacaacaccgtgggcatgctggagagcgtgtccaagttcaatctgacgctcatccgcccgggcgccgcctcctcgctcctggctggttcccggcggtcgtcgtgtggcgcgtgcgacagcgccagcgtcagcagcggcggcagcagtcaggggtctcgggcgtcgaacaacagtctgtcggggctcatgaacagccggcggctgttggcgggcgcgttcgagatccaagccgaagagaagatccatttcttcaagcagtttctctgcaagcgcctgcgccggctctcctcggtcttgcagcagctgcagcagcgcatgctccaggcgccgcagacgtccatctcacagacggggttcaatctggtgtcggagaatcgtcgacgcctgcagtcggtcatcggccggctggagctgtggcaagggtaaactagtggatccacttaacgttactgaaatcatcaaacagcttgacgaatctggatataagatcgttggtgtcgatgtcagctccggagttgagacaaatggtgttcaggatctcgataagatacgttcatttgtccaagcagcaaagagtgccttctagtgatttaatagctccatgtcaacaagaataaaacgcgtttcgggtttacctcttccagatacagctcatctgcaatgcattaatgcattggacctcgcaaccctagtacgcccttcaggctccggcgaagcagaagaatagcttagcagagtctattttcattttcgggagacgagatcaagcagatcaacggtcgtcaagagacctacgagactgaggaatccgctcttggctccacgcgactatatatttgtctctaattgtactttgacatgctcctcttctttactctgatagcttgactatgaaaattccgtcaccagcccctgggttcgcaaagataattgcactgtttcttccttgaactctcaagcctacaggacacacattcatcgtaggtataaacctcgaaaatcattcctactaagatgggtatacaatagtaaccatgcatggttgcctagtgaatgctccgtaacacccaatacgccggccgaaacttttttacaactctcctatgagtcgtttacccagaatgcacaggtacacttgtttagaggtaatccttctttctagaagtcctcgtgtactgtgtaagcgcccactccacatctccactcgacctgcaggcatcgagcctaggctagctctagaccacacgtgtgggggcccgttaacgttaactggttcccggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggaggcgcggcgatcctgcaagctccggatgcctccgctcgaagtagcgcgtctgctgctccatacaagccaaccacggcctccagaagaggatgttggcgacctcgtattgggaatccccgaacatcgcctcgctccagtcaatgaccgctgttatgcggccattgtccgtcaggacattgttggagccgaaatccgcatgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatcgcctccgcgaccggctcgagaacagcgggcagttcggtttcaggcaggtcttgcaacgtgacaccctgtgcacggcgggagatgcaataggtcaggctctcgctgaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatttggatgcttgggtagaataggtaagtcagattgaatctgaaataaagggaggaagggcgaacttaagaaggtatgaccgggtcgtccacttaccttgcttgacaaacgcaccaagttatcgtgcaccaagcagcagatgataataatgtcctcgttcctgtctgctaataagagtcacacttcgagcgccgccgctactgctacaagtggggctgatctgaccagttgcctaaatgaaccatcttgtcaaacgacacaaattttgtgctcaccgcctggacgactaaaccaaaataggcattcattgttgacctccactagctccagccaagcccaaaaaatgctccttcaatatcagttaacgggcccgttaacgttaactggttcccggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggaggcgcggcgatcctgcaagctccggatgcctccgctcgaagtagcgcgtctgctgctccatacaagccaaccacggcctccagaagaggatgttggcgacctcgtattgggaatccccgaacatcgcctcgctccagtcaatgaccgctgttatgcggccattgtccgtcaggacattgttggagccgaaatccgcatgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatcgcctccgcgaccggctcgagaacagcgggcagttcggtttcaggcaggtcttgcaacgtgacaccctgtgcacggcgggagatgcaataggtcaggctctcgctgaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatttggatgcttgggtagaataggtaagtcagattgaatctgaaataaagggaggaagggcgaacttaagaaggtatgaccgggtcgtccacttaccttgcttgacaaacgcaccaagttatcgtgcaccaagcagcagatgataataatgtcctcgttcctgtctgctaataagagtcacacttcgagcgccgccgctactgctacaagtggggctgatctgaccagttgcctaaatgaaccatcttgtcaaacgacacaaattttgtgctcaccgcctggacgactaaaccaaaataggcattcattgttgacctccactagctccagccaagcccaaaaaatgctccttcaatatcagttaacgggcccgagctcgcggccgctgtattctatagtgtcacctaaatggccgcacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaacaataaaactgtctgcttacataaacagtaatacaaggggtgttatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagaattaattcatgaccaaaatcccttaacgtgagttttcgttccactgagcgtcagac

SEQ ID NO: 240 - DNA, 22 bp, Artificial Sequence
  Phsp9 fw (MoA 657) primer
ccaaggctccgatgtgatcaag

SEQ ID NO: 241 - DNA, 20 bp, Artificial Sequence
  TF rv (MoA 679) primer
gcggagggttctcgaggaac

SEQ ID NO: 242 - DNA, 9450 bp, Artificial Sequence
  pHOFF6-transporter10  plasmid
ctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggaggcgcggcgatcctgcaagctccggatgcctccgctcgaagtagcgcgtctgctgctccatacaagccaaccacggcctccagaagaggatgttggcgacctcgtattgggaatccccgaacatcgcctcgctccagtcaatgaccgctgttatgcggccattgtccgtcaggacattgttggagccgaaatccgcatgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatcgcctccgcgaccggctcgagaacagcgggcagttcggtttcaggcaggtcttgcaacgtgacaccctgtgcacggcgggagatgcaataggtcaggctctcgctgaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatttggatgcttgggtagaataggtaagtcagattgaatctgaaataaagggaggaagggcgaacttaagaaggtatgaccgggtcgtccacttaccttgcttgacaaacgcaccaagttatcgtgcaccaagcagcagatgataataatgtcctcgttcctgtctgctaataagagtcacacttcgagcgccgccgctactgctacaagtggggctgatctgaccagttgcctaaatgaaccatcttgtcaaacgacacaaattttgtgctcaccgcctggacgactaaaccaaaataggcattcattgttgacctccactagctccagccaagcccaaaaaatgctccttcaatatcagttaacgggcccgttaacgttaactggttcccggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggaggcgcggcgatcctgcaagctccggatgcctccgctcgaagtagcgcgtctgctgctccatacaagccaaccacggcctccagaagaggatgttggcgacctcgtattgggaatccccgaacatcgcctcgctccagtcaatgaccgctgttatgcggccattgtccgtcaggacattgttggagccgaaatccgcatgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatcgcctccgcgaccggctcgagaacagcgggcagttcggtttcaggcaggtcttgcaacgtgacaccctgtgcacggcgggagatgcaataggtcaggctctcgctgaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatttggatgcttgggtagaataggtaagtcagattgaatctgaaataaagggaggaagggcgaacttaagaaggtatgaccgggtcgtccacttaccttgcttgacaaacgcaccaagttatcgtgcaccaagcagcagatgataataatgtcctcgttcctgtctgctaataagagtcacacttcgagcgccgccgctactgctacaagtggggctgatctgaccagttgcctaaatgaaccatcttgtcaaacgacacaaattttgtgctcaccgcctggacgactaaaccaaaataggcattcattgttgacctccactagctccagccaagcccaaaaaatgctccttcaatatcagttaacgggcccgagctcgcggccgctgtattctatagtgtcacctaaatggccgcacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaacaataaaactgtctgcttacataaacagtaatacaaggggtgttatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagaattaattcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctaatacgactcactatagggaaagctcggtaccacgcatgctgcagacgcgttacgtatcggatccagaattcgtgattcacaggatcccaactgatattgaaggagcattttttgggcttggctggagctagtggaggtcaacaatgaatgcctattttggtttagtcgtccaggcggtgagcacaaaatttgtgtcgtttgacaagatggttcatttaggcaactggtcagatcagccccacttgtagcagtagcggcggcgctcgaagtgtgactcttattagcagacaggaacgaggacattattatcatctgctgcttggtgcacgataacttggtgcgtttgtcaagcaaggtaagtggacgacccggtcataccttcttaagttcgcccttcctccctttatttcagattcaatctgacttacctattctacctaagcatccatgccctccgccagcgagaccactccccttctcggggaggaccagtgcccaaaatcatcccagggggccatcgtcccagacttcaagccaccccaagatgagctgaaagcacatagcattttcacacggccacaaaagatcctgatcgtcatcatcgcctccctggctgccttcttctccccggtttcgtcggccatttacttcccggcgctgggcaccttggccgatgccctcggagtgtctgtctcgttgatcaacctcaccgtgaccacgtatctggtaacgtaggaccctacatgatccctctattgttctcccgctgaccgacttccccaggtcatgcaagggctggcgccctccttcattgggagctggtccgatcgagcggggcgacggccgctctacatcgcgtgcttcgtcatctacattggatccaacattggactggccctccagaccaactacgtggctttactgatcctgcgaatggtccagagcgcgggcagcagtccgttggtgtccctggcccaggcagtcgttgcggacatggcgacctccgccgaacgaggccgttatatcagctatgtcacctccggggccatcctgggcccggctgtgggaccgttgatcggaggcatgctgatccagtcgtttggctggcggtcggtcttttggttcctggccatcttcgcgggcgtcgtctttctcctcatgctcgcctgcctgcccgagacctgtcgcgccgtcgtgggagatggctcgattccccctcccacctggatccatatgtcctggctggcatatcgacaccgacgacaaatacccctaaacggccccccgatgaccatctccacgagtccagcagccattcgacccggacgcaaggccagcccgaccggatccctccgcgtgatcgccgaccgggaaaccagcctgatcctgatctacgccggctgcgtgctggccgggtaccaaatggtgtccgcgaatctgtcggaggcactctcggcgcagtacgccttcaacaccttccaggtgggcttgtgcttcctgcccttcggcgccggggctttcctggcgaccctcacgaccggccacatcgtcgactggaacttccggcgcttggcgcgcatccaccacctggacctccgccagggccgccagcaggatctgtcccagttcccgatcgaaaaggcgcggctgcaggtcggcatgccgattgtcggggtcggcgccctgtcggtgctggtgtacggctggacgatgcaagcgcgcacccctctggccgtgccgctggtggcgctgttcgtggtgggctggacggtcagcagctcgaccaactcgatctcggtcctcatcgtcgatctgcatctggacacgccggcgaccgcgacggcggcgaataatctggtgcggtgctggatgggggcgctggcggtggccgtgatggggccggccgtcgaggcgatcgggatcggatggatggggacggtgatatgcgccgtctatatcggcctgttgcccatgctgatgctggtgtggaggaaagggccgacatggcggagggagaagagagaaaaatggccgatgatgacttgaactagtggatccacttaacgttactgaaatcatcaaacagcttgacgaatctggatataagatcgttggtgtcgatgtcagctccggagttgagacaaatggtgttcaggatctcgataagatacgttcatttgtccaagcagcaaagagtgccttctagtgatttaatagctccatgtcaacaagaataaaacgcgtttcgggtttacctcttccagatacagctcatctgcaatgcattaatgcattggacctcgcaaccctagtacgcccttcaggctccggcgaagcagaagaatagcttagcagagtctattttcattttcgggagacgagatcaagcagatcaacggtcgtcaagagacctacgagactgaggaatccgctcttggctccacgcgactatatatttgtctctaattgtactttgacatgctcctcttctttactctgatagcttgactatgaaaattccgtcaccagcccctgggttcgcaaagataattgcactgtttcttccttgaactctcaagcctacaggacacacattcatcgtaggtataaacctcgaaaatcattcctactaagatgggtatacaatagtaaccatgcatggttgcctagtgaatgctccgtaacacccaatacgccggccgaaacttttttacaactctcctatgagtcgtttacccagaatgcacaggtacacttgtttagaggtaatccttctttctagaagtcctcgtgtactgtgtaagcgcccactccacatctccactcgacctgcaggcatcgagcctaggctagctctagaccacacgtgtgggggcccgttaacgttaactggttcccggtcggcatctact

SEQ ID NO: 243 - DNA, 18 bp, Artificial Sequence
  Transporter 10 fw (MoA 812) primer
agcaggatctgtcccagt

SEQ ID NO: 244 - DNA, 20 bp, Artificial Sequence
  TtrpC rv (MoA 800) primer
caagagcggattcctcagtc

SEQ ID NO: 245 - DNA, 16205 bp, Artificial Sequence
  vector pHOFF6 Phsp9-polyketide synthase
ctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggaggcgcggcgatcctgcaagctccggatgcctccgctcgaagtagcgcgtctgctgctccatacaagccaaccacggcctccagaagaggatgttggcgacctcgtattgggaatccccgaacatcgcctcgctccagtcaatgaccgctgttatgcggccattgtccgtcaggacattgttggagccgaaatccgcatgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatcgcctccgcgaccggctcgagaacagcgggcagttcggtttcaggcaggtcttgcaacgtgacaccctgtgcacggcgggagatgcaataggtcaggctctcgctgaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatttggatgcttgggtagaataggtaagtcagattgaatctgaaataaagggaggaagggcgaacttaagaaggtatgaccgggtcgtccacttaccttgcttgacaaacgcaccaagttatcgtgcaccaagcagcagatgataataatgtcctcgttcctgtctgctaataagagtcacacttcgagcgccgccgctactgctacaagtggggctgatctgaccagttgcctaaatgaaccatcttgtcaaacgacacaaattttgtgctcaccgcctggacgactaaaccaaaataggcattcattgttgacctccactagctccagccaagcccaaaaaatgctccttcaatatcagttaacgggcccgttaacgttaactggttcccggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggaggcgcggcgatcctgcaagctccggatgcctccgctcgaagtagcgcgtctgctgctccatacaagccaaccacggcctccagaagaggatgttggcgacctcgtattgggaatccccgaacatcgcctcgctccagtcaatgaccgctgttatgcggccattgtccgtcaggacattgttggagccgaaatccgcatgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatcgcctccgcgaccggctcgagaacagcgggcagttcggtttcaggcaggtcttgcaacgtgacaccctgtgcacggcgggagatgcaataggtcaggctctcgctgaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatttggatgcttgggtagaataggtaagtcagattgaatctgaaataaagggaggaagggcgaacttaagaaggtatgaccgggtcgtccacttaccttgcttgacaaacgcaccaagttatcgtgcaccaagcagcagatgataataatgtcctcgttcctgtctgctaataagagtcacacttcgagcgccgccgctactgctacaagtggggctgatctgaccagttgcctaaatgaaccatcttgtcaaacgacacaaattttgtgctcaccgcctggacgactaaaccaaaataggcattcattgttgacctccactagctccagccaagcccaaaaaatgctccttcaatatcagttaacgggcccgagctcgcggccgctgtattctatagtgtcacctaaatggccgcacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaacaataaaactgtctgcttacataaacagtaatacaaggggtgttatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagaattaattcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctaatacgactcactatagggaaagctcggtaccacgcatgctgcagacgcgttacgtatcggatcggacaattgtctctatcgtagatgtatcttgtaaagtcgtctgcgatgccttcgaggggcggagactctaaaagagaatcaagagataagaagattgaaaagtatcagatcgagaactacagaaagtgatgtgaacaatgagagcacaatcaaacacggaaggctgaatagcatggctgtcgatgtgactcgacagataaaatggtggtcatgaaggcatagaccgtaggacgagtggttgatacagaagaggagagccagcggtgagtcggcggtggcgtggacgtcggtgactcgacgggataagccctgctcaccgctttcctcttttgacgtcgccgagaacgctcgaccgatctggcaaggtctgatctcggccggagtaataaattatccgcaatcccaagtcatgtgatgcgccaaggcccttgcctgcttcaggttaggctgtggcttgcatctcagcagggaagcgccacagatctaaggatcatcgcgacgtcatggatggtgacatcgacgaggaagacgcgttcagtcttgtttctcaagccacaatgatccctgctggggtctggaacgtcagccaaggctccgatgtgatcaagcgcggggacacgaatctccactcttgattcaatggcactattttccagccctgatatccagtcgttcaagtgtggggacgctcaaggtaggataatgtaggataacgtacctaggataccagtttccttgtatgtatgtcctgcaagtaattactcgtgtatttaccatgtgctcctgaatcgacgtcatggactgagggagagatgtgaaatccgtggtatataaacctccacgatcttccagctttctgcatacaacagcaatctccatctcaaacacttaaccactctctcgaagataactactcttttcaaaccaaaacttcttcattcaaacaactgcaaacggatccatggttgagaatgtctcctctccttcgtcgccacggacttcgagtccgagtggctcctgtacgcccaccagcgccaccagcgtgggatccgacgacaagagtatgcccattgctgtcgtcgggatgagctttcggggccccagggatgccatcagcgtggagagtctctggaggatgatctccgagggccgcgagggatggagtaaaatccccaagtcacgatggaataatgacgccttctaccatccggatcatagtcggcatggaacggtgagggcttccttttctttgaaagctgaacgcgaagcgagatcaaatggaaagttaaattcctaataaaaattacgagtggctaatggaaacgcttagatcaatgttgaaggagggcatttcttggaagaagatctcgctcgcttcgatgctccctttttcaatatgaccaacgcagaagcagccgtgagtattaagagatttctgacatgcaactatcgtggctgaaacccgtcaggcactggatccccaacaacgactgctactcgaaagcaccttcgaggctgtcgaaaatggtgagttgttggtctttgtttcccagaccaaaatgaatccctgacgatcgtagcgggaatacccctggacaagatgcttgggtccaagacctcctgcttcgtgggctccttctgcggcgactacaccgacatgcttgtgcgagaccccgaggccatccccatgtaccaatgcaccaacgccggtcagtcgcgggccatcacggccaaccgggtctcctacttcttcgatctgcgtgggcccagcgtcaccgttgatacggcttgctccgggagtctagttgccctccacctggcctgtcagagcttacgaacgggggatgcgaaaatggccattgtctccggggtcaataccattctgagccatgagtttatgagcactatgagcatgatgcggtaagagtcgtacccctatcgttttgcggatccagtctctcacaatgtcaggttcctgtcccccgatggacgatgttacacgtttgatgagcgggccaatggctacgcccgaggcgaaggagtcggctgtctacttctgaaacccctgtcggatgccctacgggacaatgatacgatccgcgccgtcattcgagggacgggctccaaccaggacggtaaaacgtcgggcatcaccttaccaaacgccaatgcccagcaggaattgatccgcgacgtctacgcggctgcggggctggatcctctggaaaccgagtatgtcgagtgccacggtaccggcactcaggccggcgatcctctcgagaccggcgccgtggccaaggtcttttctcctggccggccggacgatcggccgctgcgcatcggctctatcaagacgaatgtcggccacttggaaggggcgagcggcattgcaggcgtgatcaaagcggtcctgacgctggagaaccaatgtttcctcccaaatcgaaacttcaagagcattaacccgcgcattccgctcaaggagtggaaattgaaggtgcgtgagttgtcgtcgtctgctaccatcgtcgtctgctaccaacaagaaactgacatcgtcagatccaactggagaatgaacgatgggaaacagtaggcccccatcgggtctccgtcaacagtttcgggtacgggggaagcaatgcacacgccgttcttgaagacaccaagggttaccttgaacagagatccctaacaggctccttccgccgcgtacgagcgcttccccatgccgccactgacctcgagccagtctcggacccgggttctggcccagagcgtacccgactttttgtcctgtccagttttgatcaggcgtctggtcagcaacagatcgaccaactgcgggaatacttggagcagaactcctctcgaatagatgatcaatacctggcagatctcgcttacactctcggcgagcgccgctcgccctttctctggaagacggcgatgccggcatcgtccgtgtccagtctcgtcgaagggttgaagactcgcgccaaggtctctcgggccgagaagaagaagccgacgctgggcttcatcttcacgggtcaaggcgctcaatggtgcggcatgggtcgcgagcttctggcagcgtatcccgtctttgcttcgagcgtggacgctatcgccacctatctgaaaagccttggggctcccttcgacgtccgggaggagctcgtccgggatcccaaggactccaagatcaatcaaccgttgtacagccagccgatatgcaccgccgtccagattgccctggtagatctgctcaccttctggggaatccggcctgcctctgtgaccggccactccagcggcgagcttgcgggggcatacacggcaggggccctgagcatggaacacagtatggccgctgcgtattatcgaggcgttgcgtccagtgatcttccccgagaccacacgcaacgaggcgccatgatggcggtgggagccagtaaagacgccatccagccccgattgtcctcgctgacgacgggcaccgccgtggtcgcgtgcgtcaacagcccctccagcgtcaccatctcgggcgatgcatccgctgtggacgagctgcatggtttgctcgagaaggaccaggtgttcgcgcggaagttggccgtcgacgtcgcctatcactcgcaccatatgaaagccgtggccgaccaatatcgcaccgccatggccgccgccggcgtcaccgcggttcagcctgagtccacggagcccgaagtggaattcttctcgtccgtgacgggcgagaaagccagcctcaccgacctgggaatcgaatactgggtcgccaacctgctcagccaggtcaagtttgccgattccgtgcatcgcctgtgcatggagacgtcggcttccggacgggctcgcaagaccaaaaccaaggcaccgaaacgctcaggggccaacaacaaggccaaggtcgacatgctcgtcgagattggcccgcattcaacgctggcagggccaattcgccagatcctcggggccgaccagacgctggagcaggcgtcgatccgctatgccagtgccctgctgcgcaagtcgagtgcggtcgataccacgctgaccctggcgtcgaccttactgatggccgggtatccgatcgacatggctgccatcaatcgaccgtcggatcaccaccgagtgggcgtcctcgtcgatctccctccctatccgtggaaccactcgggatcatactgggcagagccgcggttgagcaaagcctatcgcaaccgcgctcatccccggaacgaccttctgggagtgttggatacgcattccagcccgcgggagccccggtggcgcaattatctccggacgagcgagatcccttggatcaaagaccatatgatccagtcgaacgtggtgtatccggcggccggctacctcaccatggcggtcgaagccatcgggcaacggattggggacaacttcccgggccaccgcatctcgggataccgactacgagatgtcgcgatcgaggcggctttggtgattagcgacgactcggagccggaggtcatgctctccttgcgtccgtctggcgacagtggcctggttccggccgaacggtggcatgaattccacgtcctttcagtgacccccgacaaccggtggacggagcattgtcgcgggctcatctgcgccgaggtcgcggccatggacggggacgaagatgaccgtggcgcagaggcagggttgaccgccgagacagagcgctggatcgaggaagcggagcagctctgccagaaagacgtcgatatcccccggttctacgcagagttgaccggtctgggtctggaatacggggagacctttgccaacatgacgcgagcacgttcggcctcccatgtctgcctcgcggagatcgaagtcgcggacactgcggctgtcatgcctctgggattccagtctccgttcgtggtccatccctccaccctggacagtctcttccatcctctcttcgtcgctctgtcctccgacgagtcactgcaagatcctgccgtgccggtggccatcgaggagatatggatccgccacggcatggccaaggaggccggacacaagttccaggtctgcgcgtcgacccaggagacgggtcgagaccgcattcaggcagctatctcggtggttgatgctcagagggctcgcagcggaccggcgttgacggtccgcggcctgacgtgccagttcctggaccgcgcatcgggagatgtcgagggcgacgagcagcctacacggcttgcatacgagcttcactgggaggcagatgtagacctgctgtcgtcgagcgacctggccacgctgtgtgcggttggccgtccccgtgatgtaggggagaaggtcgctcgatatgtgaagcttctcggacacaagaaccctcatcttgccatcctggaggtcggagccggtcagggagagctgtgtattccggtgtttcgagccctggcaggggaggccaacagcacgccctcgttccagtcatatacactcgccgacaccgagccgggactgtcggagaccattgccacaattgccgaccagtttgacgaacgcgccgatctgattcaatataaggagctcgacatctcgtcggacccgctgcagcagggcttcaacgctcactctttggacctcatccttcttccttcccggggagtgtcggccacgctccgatcgaagatcctcaaacatgcgcaccaattgctcacgcccgaagggagactgattgtggtcgacacgagggacctgcaggaatggtggcaagctcttcgtgagagcaactttactgatccggaagtgattcacgacagtccgagcgagacggaggccgacatctcggtgctggtgtcgaaaccacaaccacaacctcgggatcagaccccatcagaccctccggatgtcctggttatcgccgagaaccaagactccggcgtgtccattgagcatctccagcgtctgctggcggacgctcatgtgccggcgaccgtcacggatttcgctcatgcagacccggagggcaagacgtgcattgttctcagcgagttgacgacctctctgctgagccatcccgaccagcattcgtttgaaacgctcaaaaggatcctcgtcgccgggggtcgcggcgttctctgggtcgttcggggagcaaccggcccagcgcccaccagcagtctggccaccggtctgctgcgcacgattcgctccgagaccgacgatgatcgaccgattgtgagcctggatctggatgcctcccatcccctgtcggcggaatccgcagcgcaatcgatcttctccgcgttccgccaccgattcgtctcccccggagggagtcacgaggtcgaatacgccgaacgcgatgggatcctgcgcatccctcgcgtcgtcgagagttccctcgtcaaccacgagattgtctcgtccttgcggccggcggtggccgaggaccagccattcttccagcccggacgtccgctggaactcaccgtcggcaccccgggacgtctcgacagtctctactatgtcgaccgctcctgcatctcggagctacccagtgactacgtcgagatcgaagtcaaagccatcgggctcgggaacggcgatgtcaagaccgctctgggacatgacgatgccgcaacccgtctcggagcggaatgcagcggtgtggtgactgctctcggggacgccgtttcgggcttcaagatcggagaccgtgtcgctggctttggcgcaggaaccgtcgccactttataccgagaccaggcggcgcggttccagctcatccccgacgacatgagctttgcgcgtgcggccgctctccccgtggcatatatcactgctttcttcgcggtccacgcgctgggccaggtgagccgaggggaccgagtcctcatccaggacgccggcacggccgcgggccaggctctcctggagctctgtgccctcgccgggggggatatcatcgccgtggtggattcgccctcgcaaagagccttcctcgttggcgagtacgacctcccggcgagcagaatcctggtcggtctccgcggacgacgtctagcaaccagcgtcatgacgctgactaggggctgcggagtcgatgccatcttcaatttccgcggaggcgaggagagacgcctgtgctggagctgcgtggcaccatatggccggttcattgacctgggcggcggaccgtccgacctgacggatatgccgcagctcgagatggccagcttcttttccaagaatgcttccttcacggctctggacttccactacctggtcacgcaaaagccacaggcggtgcaccggatctggtccgacgtgatggccctggtgcgagcaaaggccatccggggcccgcccaggcttcaacttcattccgtctccgaggtcgagaccgcgttgaaacagagtcaggacggatgtgatgtcgagaaagtggtgatccgtgccgaacgggatacaatcgtccaggtctgttgccactctgccccttatgatatcctccctcgtgctaatatgttctcttgcaggccattcctcctccgaagggcgacctgctgagggccgacgcgtcatatgtgctagtcggcggcctcggaggcattggacgagcgatggcatcgtggatgattgccaacggagcccgacacttaatctttgtcaaccgcagtggcctcgcccgcaacgaagcccgggagacggtcgagtctctcgagggtcacggtgcccacgtggcggtctattcttgcgatgtcagcgatcgcgaccaagtcgctcagatggttgctcagagctccaaagagatgccgcccattcgaggcgtgattcaggcggccatgattctccgggtatgtctgccttctcgaaattagtaggtcgaggactgactgtagtaggatatgctgtttgagaaaatgagcgtcgacgacttcaacaccgtcctacagcccaaatggcagggcacatggaatcttcatggcctcctaccccgagacatggacttctttatcatgctgtcctccatcagcggggtcatcggcaacgccactcaggctgcctatgccgctggatcgacgttcttgggcgcgttcgcccagtatcgcagctccctgggactaccggccgtgacgctggatctcggcgttatcactggaatcgggtacctgtccgagcacgaggagctgctccagggcatgcagcgacaaggctttgaaggcaccaacgagcagacgctgatggccctcatccgatcagccattgtcagccctcgtcggacggggtcacaagccgagatcgtcaccgggctggggacctggcgagagggcgtctcgctgggcaacttcgaccagcccttgttcgcgcacttccgccgtcaagccctgggactccgagatgccacggcagagggcccgggcaccagcgtccgggagagtctccggggatgcaagaccctcgacgatgcggtggctctggtctgtgcggctctgatcgaccgcctggcctcgagattgaacaccccggtggacaatatcgactcccagcgggcgatgtcggagtacggggtggactcgctggtggcggtggagatgcgcaactggatcggcaaggagatggagagcacgatgcccattctggagctgctggcgaatcaatccatctcgcagttgtcggagaagatagctcagcggtcaaaggtggtggcagtgagtggaagtgaagagtagggatccacttaacgttactgaaatcatcaaacagcttgacgaatctggatataagatcgttggtgtcgatgtcagctccggagttgagacaaatggtgttcaggatctcgataagatacgttcatttgtccaagcagcaaagagtgccttctagtgatttaatagctccatgtcaacaagaataaaacgcgtttcgggtttacctcttccagatacagctcatctgcaatgcattaatgcattggacctcgcaaccctagtacgcccttcaggctccggcgaagcagaagaatagcttagcagagtctattttcattttcgggagacgagatcaagcagatcaacggtcgtcaagagacctacgagactgaggaatccgctcttggctccacgcgactatatatttgtctctaattgtactttgacatgctcctcttctttactctgatagcttgactatgaaaattccgtcaccagcccctgggttcgcaaagataattgcactgtttcttccttgaactctcaagcctacaggacacacattcatcgtaggtataaacctcgaaaatcattcctactaagatgggtatacaatagtaaccatgcatggttgcctagtgaatgctccgtaacacccaatacgccggccgaaacttttttacaactctcctatgagtcgtttacccagaatgcacaggtacacttgtttagaggtaatccttctttctagaagtcctcgtgtactgtgtaagcgcccactccacatctccactcgacctgcaggcatcgagcctaggctagctctagaccacacgtgtgggggcccgttaacgttaactggttcccggtcggcatctact

SEQ ID NO: 246 - DNA, 20 bp, Artificial Sequence
  primer PKS rv (MoA 962)
acgaagcaggaggtcttgga

SEQ ID NO: 247 - DNA, 10889 bp, Paecilomyces divaricatus
gcattcaagaggtatcaatgaaacgtcattatcattatcaataagaagcatatatatacatgacttcaggcagctacatgtatatatacattagtcttcgtgtatatatatcagggtcatgatgagactggcgcgtaagtgaaaataatcacaaggttaatagaaagtcatgcctcatattcaaggtcttccaatccagtctttacccttgccacagctccagccggccgatgaccgactgcaggcgtcgacgattctccgacaccagattgaaccccgtctgtgagatggacgtctgcggcgcctggagcatgcgctgctgcagctgctgcaagaccgaggagagccggcgcaggcgcttgcagagaaactgcttgaagaaatggatcttctcttcggcttggatctcgaacgcgcccgccaacagccgccggctgttcatgagccccgacagactgttgttcgacgcccgagacccctgactgctgccgccgctgctgacgctggcgctgtcgcacgcgccacacgacgaccgccgggaaccagccaggagcgaggaggcggcgcccgggcggatgagcgtcagattgaacttggacacgctctccagcatgcccacggtgttgtcgatcttcagcgccaccagcaggaggaggtccgggcgactgccggaacatccctggcactgcaggacctgcgccgcctgccggtgggcgctctgctccagggccacgagcatgtcgatcgagcacgccagtcccagcgaggtgcggcgatcgaaatcccccaggctggccagcaccgactgatagcattcgcagtgccgggccggcggcgccgatgggagacgctgcggcctcggcgccgacccctcgggatggctgtccgccggcatggacatcgggtagccgacccctggctcctccggggccggcggaggcagtccggggcccgccgacgactcgaagggcggagggttctcgaggaacaggaaggcatcccccatcggagccgccgccgatttgaacgattcaaggaaggatgggggctcggtgccgggcggacaggggccctggtcactgggggccatggacgcaccggcggtcattccgctcagcgtcggcccgtcgaagtccaggatagactccagatcgaatgcggggggtcccgaggggtcccccgcggggtcatgattcgagccatccatctccagccaggcgtcgtcatccatcctggcggcggcggccgggccgtgcccgagcagaaaggcatgatcgtatgaggaggaagacgagaaggaatcgaccgcacggtggctgatggagatggatgccgtcgtcgggggcaatggaggctcggcgggactgccttcggaggcgtgtgtggacgccgtgttgttgccctggaaggcacggtttttgctcctcttgggggtcttctctctctcggccgcgtcgccggggggtttccgccgcggcggacgtccaatgcgtcgcagggcactgtacacgcagggaactttgttgtacttgcagtgttggcacggctgttcgcgcgagcaccgatgtttggccttctggcaggcgtcacacgtggagcgcagtttcaccggctcgccgggcttgcttgccgtttcgccagggctgggcggatgtgggaaggatgaggatggcatggacggcggagaaagagccgactctacataggatggatgttggtagatactcgggtgtggattggaaggctggatcgtacgatccggcaagctacatactagtattgctgacgagagaaacgcagaagagatatagttaacacggataaaagagaacctcgataaccctcaatcgcagtacccccgcatgttccccgcctctcatcttcacgattggcccagccagttgggggctgaaaggagtcattgacgtcaattctgcatgctctacatgctggaaggattcggcgtcagctgcagatcgcataaactggttgtgtagcatccatcacatacttaaaaagcagtccagacacaacaaacgcagtaagaaggtaagaagagtgtgtatcaattcccctccgggcagtggccaggccctcttcggagtgtctccgacagtaacccatccgggtaagagataagcttcatcggacctaataggtgaagtatatctaaaacacggctctgtcgatctcgcgaaaagcccgcggtgggttttgaggctggtttcggccacgcaatcctcaacgaatctcttgttggccaagagccattagttcccaccaaattcctcagatgtcacctaaaccttgattatttcctcagatgccatcctgcacgctcctggtatgatccacctgtattcggacagtaagagggctcgatgtggttttatgcaataaacaagcctttcatcatttgctatactgaaatagcttaaaaggaggccattgactctttataaagatcagtattttattactcctttttcgaataggggttgtttcagcttctagtagctgtacttaaatataaaaaaatacatgattttagagttgtctgcacagacgtacatacctcctgtacgataacagcgattattccccgattcggcatatcaaaaacgcgcggcacgggggaatttaatttgggtttgggtggtatccggggaaccaggcgcattggttcgtcgtgttaggagctccgccgatcagcgggagtctcggacgataggcagggggcggtagtgcttacagtcttcatggacatgtagtgacgagtgtgccaagcaccacagctatataaacatacttttggccccctactgggttcttgcagactcctctccgcagaagcttgttcggccccggaatcatattccccgtcctttgttggcagatcgacccggtccaggcatatatatcggtgccaaaaagaccccgaaggccccgatgttgaccaaaaaggattttaggtgcagccagccacttccgcccatgtatccgttggtaattgctagcggaaggagtccacgacgcaagagcagtggatcaggttgatcatggctgattatcgccaattatcaatggaaaagaatcctgctggtcaattgcctccattgtcttcggatatgagccggtgcggcgtgtttttctgcacacaaatcatgccgaatcatctctggcgaactcgatgattccgtgatgcattatcttgtttctccaacaccacaagaaatcgccgctctgcgccgagatataatctctgaaccggcgtccgagtatccgaatggataggtaactcacctccagtccttacagagacatcctctggcggataccctccacaatgcatttcaatcttctcctcgtcttgaccgtcctcctccgccaggctacggcactcgtcctgccgccgtccaacagcacctccaattcgaccggcaaattctccgcccgcaccgtcttccagttcccccagggatactggctggagaatctggccgtccggggcaatggccaggtcctcgcaaccacctacatgccgtcggccggcctgtatctcatcgaccccactcccaatgccagctatcccgcggtcctcgtccaccagttcgagaactcgacctcggccctgggcatcgtggaggcggaggggacagagcccgacaccttctatctggcgacgctgaacttctccgccgcggacggcttcgtcccccgcaccagccaggtctggcgagtggacatgtcctcgttccactactcaccccagaccgggcaggtctccgggaaggcggccgtctcgcatgttacgacgctgtcgtcggtgggcatggccaacggtatgaccctgctggctccggactcgtcgcacatcctgatcgcggactcccttcggggcgccatctgggacctggacaccgcgacgggccactatggcctctcgtcgtccttccccgccatgcggtccgacaatccggcgcgccgcttcctcgggatcgacggagtcaaggtgcaccagggcagcctgtatttcaacaatgcgggtgaattcaccctcgcccgcatgcccatccacagcgatggcatcgccaagggggagccggtcgtcctggccacggacctctacagcgatgggttctgtctgtacgacgccgacacggtgctggtgacgatgaacatcgacaacggcctcgccgcgctggacctggagagccatcgccggtggatggtggccggcaacatgcccgacggggtctttacgactccaacgtcggtcgagctgggccgcggggaggacgcgggcaaactcgcctacgtgaccatgggaggcacctacgtggcgaccggtgccgaggatctcgtcgggggcagcttagtcgtggtggacctgaagtcggccacgaccgatccgaaaggaacgggaagaggtgggctgctggtgcaggagacagagacgatttggttggagctgtagagagggggttcagtgctagaacattcagatgtactcgagtagtggtttatcatcttgaaaatagcaagctgtctactcatatatgtagtccagtatagggagagtttaaagaatgggagatatcattattaaaactgaacgataccagatacaaaaaatcattttgacccaaagtgcatcaaggtacgtcgacgtgttcctatatacatgttcctatacacatgggtcgcccgtaggcactggaaatacaaatttcacctctggcctgaaagaccctaagaaggaaaaatcatatacagagttttccgccctataaataataccttaaaggagctttcaagatgtgtccaaacacagtacccatcccctgctggtcatagcttcgccgacggcgccgtcatctcgagcactggttcggtctcccccgtgtagacgtgcgtgggccggaagaggcggattttgtttttcactgcgggcattttatcagctctcttgcccttgcttgaaagttggaaatcggctggacctacacatggactcccgataatgcgccaggatgcccaccaaccgctgtgctaccattgcaaccgggatttcctccggttggaatcccctacgacccgaccggtcaattgtcatccactgcaatcaacagaaaaacaacttacaggcgattaaagaaaaaggttccgtaaaagtccgcgttcgcatgcagttttcgtttgatgaaatactcatcggtcgacgagaggcgatcgatctcccgcgccaccttgaccagcggatccgagtccccgtccagctcgctgaagagcatatctttgatgggcttcacccgggggtcgatcgtcgtgtacgtgcgatggccgtacccaaacagccgccgcttgccagacttgacctcctccagaaaagccggcacctggtcgacgctgccgaccgcttggatggttttgtattccgcctccggggcgccaaagtgcaggggcccgtacgcagccaccagggagctgatgaggcccgagatgggatccgtcagcgaggaggcggttaccaccatcgcaaacgaggacagcgccatgccgtgctcggagttgagcgccgcaaaccgccggaagcaggacagcttcaccgggtctggacgaccggtgtacggttcaaccaggcccatcatgatgaacaggttctcaaagtaggtgttatccgtcgtggccggcgtgaaggcgatgccgcgacggtggctggccgccatgcccatcaccaccgcgtaggcggctgccgtccggagaatggcacggtcagtctgttcgggatttccatggtagatgttgcccccggcacaggctgggatggagtcggcatggtgggccagatacgcggacagcccggccacaatcatgggcatcggggggcttgtcggactgcagggggttcagttcttcattcattcaaggtgatcgtgatggacgatgaaaagcacagtagaagacctacgggaatgtctcaatcacctccgcgacatgtttgggcgtggtcgacatgagcgtggccaaggtcagacgcaacgcctctcgctgagacggcgtgggatatttgccccagaccaagagatgcagcatgtcctcgaactcggcctgccatagttgctccagggcatagccccgaaaaagcaacagcccgcgatgtccgtccctaaattgagcattagtgaaataaagaaccttcccccgggggggaactctcttggacccgttccctacgtatatgtcatgttggtctccaccacgcaggtgttcttgagacccggatcaaagacccgcaggccatcgcccactttgtccgctcgatccgcgcccaccggggacgccttgatctgcttgagatcggtggcgaggacggtgttgcgccggatggggatctcatactcccgcgatgtgcgggagtctcggatatgtagagctccatgcgacatggtgaagctgcattcatgatggatgcatgctgcattacaatttctatatatattcgacagatgatattcctcgtttatccccaggaattggtggaagcctccgtgttcatcattatcggggagttctcgtgatgtgatttcctaatgccacatgttccaatcctgtgaatgccccggaatgttgctctgccaatgagaaaatcgccgccagcgtttcaatggtggcccgggatgtagaagagcatttgaaatctcggcatttccttttcccaagaaaaagaccgagtccgccgggttctttttcgaaggaatgtgagcattgctgctgccggttcccaggtttctctgcaaagaccctttctttatactatctggaagaaatagtacgatctgttgtttctctgatgtgatctgtagctttggaacctaaatattcaaagaagaagaaaaaagaattaccttctttttctctgccttctactgccttcctgcgtagtctttctttcctttttgcagtgagtttgctaaatattcccgggatatgtttccgttacggaacgaggacgaaatacgtggctttacgaaccaacatgaaaaaggaactccgaggttgacggcaccaaatttccctcgtgacagtgcgataattatttcagtgagcatcaatacggagaaatagacccatgccaagtacaagtgtagtttttaagcgaaatcaatgctattccggtaatctctactttatagacaaaacaaacagcacaaatacaccatatactcacaggagcgtcaaagatcgaagtcaacagcatactcagtacttgatagggaatgaatacaacatcttttcagccgacctttgacgtagcgtcattatggctctctatattctattcacctttttattttccgctaacaatacttgaagctggcattcatcgtctaggcttgactagcttataccatacgaaaccagatctatcgacttttagatatcagtatgaggaaatcaaaagcaaagaaaagtaaagtctcaattgtttttactattaaactgttctttaccaggtagccttttgcaagtgatcatcagattcaacacccgtggttcttgatatctagccatgacttgagaaaaatatcagcacgctagtctccatctgatacgtaagtccctttagactagggatttgttgaaccttctgttactgaaggcaagtaaatcgcggatgatggatctgttttggtcaacatagaatggtatgttcgctcactccaggctgaaaaccagactctactgctctcgagaccaggcccactattcaatcgtcaagaacctccggtcccatttatctgaggatcaaatgcagtagcaacagacgacggcagtgtgggagtttcagagagttctgatcattgtcctgctagcctggctgctgatgctgtagacggatgagtctggtcgaggtcatgcccacacctccatatcagcacgatatagtgaccgcggagggatactttaggtccctaactccgttcaggtccgagagggcctccgcatgacgccgtcgatatcaagtcaccgttccctcctcattgcccatcctagggtccccgatataagggcaacgagcggtcagtagactctatagagttcagccatccactactttctctacatccacaacatccccatcgagtattccatcatggcctccaaggaaactttcagcaaataccctgccttccccgacaacatccccacggcggcggtccccaagatctccctccgccagattttgtcccgcgaccccaccgtgtcgaagcgtctggtcgacgcgggcaaggaattcggctgcttcaaggtcgacctgaccgatgccatcgacggccctgtcctctgtcagggcgtcgagcgcggctttgacctgggcaaggccttcttcgaccaagacatcgagaccaagaaggcatacaagctgagtcacgagaacgtcgggtaggtttctccccagccgacgtcggcccagatgatactcacccacgggtgcacaggtacaagcaggccggcgttctggtcattaccaaggagcggcgagaccaggtcgagacatgctccgtctcgcgcgatgatctggcggccagccgacccgacctgccctctgtgttcgaccagcagcggctgctgctccagggcctcgttgcgcagctcgggcagctctcgcacctggccgtctaccatctgtcggagggtctggggctggattatggagtcgtgtcggcgcgccatgatccccgcgaccagtccgccacgatgatccgtttcctgcataatccgccgcagagaggaccgcgcgaggagctgccctcgaccgaggacccgggttcgcgggcctacctgatgggccacagcgacgggggcacggtgaccatcctgttcaacgtcctgggtggactgcagctccagcgccagcagcccgatggctccatcgagtggcagtacattccgcccgagcccggctgtgccttgatcatggtgggcgacgccttcaagtccttcacggacggggaagtcccctcgtgcgtgcaccgggtcatccagccgccgggcgagcaggatcgcttcgatcggtatgcgctgggcttcttcctcaagcccgccaacggggcctccattggaccagtgccgcgccggggcgtgacggagaatggcgtcaacaaggcgtcggactatggagagtgggcaaagaacaagaacgcggcgttgtacaacgagatgcgccaggagaatgtggcaatttagatgagccagacccgacttgaagcgatagagtgatgtagtaagaggggagaaagacaatgatgcgttaaacgtaactgagatgtctacccttttgtctagaagtaggcctgtggcattcaagacggatgttgtctgtagttttgtctcggaaagtatgaacacgctaatcgccctattatcttcggattagctgcactcgggaaattcccgacctcaaactttcagcggcatttatcctggcataagaatatccagcaacactatcatgaggtatagtctgacttgcagaatgccaatgacggtatctagcaagtacagaaaaggtacgattgggaaaaccaccgatattgtgacgccgcggtctcaccgttgaacagcggaatcctccacgcctacgaaaagccccttgccggagggttggtcgagcgcgacagggtatagcgagggataggcgccttaattgaatccactaccgagccttttagctagacccaggcttcttcaaacccagcttcttgtgtagctgtacggagacgcttctcctggtcaacatcatgtccagtctgcctttctagctgcttcaccaaaagcatccttgatggcattgttaaatggcaattcgtgaggtcattttctgcagttactgcgatgcggatctggtgtgttataagatggtctctcgaaatcgtacagaggccggtgtacctgcataggaggtacagtgcttgcagtagtaaatctcttgcttatgcttgtttctcgttgcatgctcactctcctttggtggctgtgtatgctgccatcagagatcattggagtgtttctttttgcgaaaaggctcagcaggttcaacagaagatgcaggttcggttcctgggctttcagtaaccacagtacggttagagaccaagccaacaagatcgaatttagcataggaagtagtgttggaccttgtgttaatatgtggcaaacaatggaattgggccttttcaatgtagaagagcggaggtgaggggtaaagtcaacaacaagttaacaactattgtagtgaaagtagacttgttcgtggggcgggtccggtccggtcaggcgaaccgaagttaccgaaccttcttttaacccggccaagtcagctcaagacctggatgggcaattctctaacctaatctagaaagaatctctagggtcccgaggtcgggtcggatcaaaggggcggatcaccgattttgacgccgcgtcccgagccggggtcgggttaacaagtgtaaattgttaaacctaaaattgaaacagattataacagaagaagagaaatccttcatagcccttttagcattgagatagcggtcggctggatggtccgggcttgcatctatcttgagggcctgaggcgtcaatcctaacttgtgccgctactggcagtacgcgaaggtccttcggatctttcggaggggacgaatctactctatgtttattcacttcccggaattattcggatgagacactctacgtacgaccgtatcctttgtcactataattagcatatggagaaaagaaaatcagatacaaggggtgtaattcgtcatgcttcatccgtcattgattcaactatctcataacaagtctacaaacagggt

SEQ ID NO: 248 - DNA, 15913 bp, Artificial Sequence
  vector comprising Fragment D encoding for the transcriptional regulator, gluconolactonase, citrate synthase and the dioxygenase (SEQ IDs NO: 24-31)
actcttcctttttcaatattattgaagcatttatcagggttattgggcattcaagaggtatcaatgaaacgtcattatcattatcaataagaagcatatatatacatgacttcaggcagctacatgtatatatacattagtcttcgtgtatatatatcagggtcatgatgagactggcgcgtaagtgaaaataatcacaaggttaatagaaagtcatgcctcatattcaaggtcttccaatccagtctttacccttgccacagctccagccggccgatgaccgactgcaggcgtcgacgattctccgacaccagattgaaccccgtctgtgagatggacgtctgcggcgcctggagcatgcgctgctgcagctgctgcaagaccgaggagagccggcgcaggcgcttgcagagaaactgcttgaagaaatggatcttctcttcggcttggatctcgaacgcgcccgccaacagccgccggctgttcatgagccccgacagactgttgttcgacgcccgagacccctgactgctgccgccgctgctgacgctggcgctgtcgcacgcgccacacgacgaccgccgggaaccagccaggagcgaggaggcggcgcccgggcggatgagcgtcagattgaacttggacacgctctccagcatgcccacggtgttgtcgatcttcagcgccaccagcaggaggaggtccgggcgactgccggaacatccctggcactgcaggacctgcgccgcctgccggtgggcgctctgctccagggccacgagcatgtcgatcgagcacgccagtcccagcgaggtgcggcgatcgaaatcccccaggctggccagcaccgactgatagcattcgcagtgccgggccggcggcgccgatgggagacgctgcggcctcggcgccgacccctcgggatggctgtccgccggcatggacatcgggtagccgacccctggctcctccggggccggcggaggcagtccggggcccgccgacgactcgaagggcggagggttctcgaggaacaggaaggcatcccccatcggagccgccgccgatttgaacgattcaaggaaggatgggggctcggtgccgggcggacaggggccctggtcactgggggccatggacgcaccggcggtcattccgctcagcgtcggcccgtcgaagtccaggatagactccagatcgaatgcggggggtcccgaggggtcccccgcggggtcatgattcgagccatccatctccagccaggcgtcgtcatccatcctggcggcggcggccgggccgtgcccgagcagaaaggcatgatcgtatgaggaggaagacgagaaggaatcgaccgcacggtggctgatggagatggatgccgtcgtcgggggcaatggaggctcggcgggactgccttcggaggcgtgtgtggacgccgtgttgttgccctggaaggcacggtttttgctcctcttgggggtcttctctctctcggccgcgtcgccggggggtttccgccgcggcggacgtccaatgcgtcgcagggcactgtacacgcagggaactttgttgtacttgcagtgttggcacggctgttcgcgcgagcaccgatgtttggccttctggcaggcgtcacacgtggagcgcagtttcaccggctcgccgggcttgcttgccgtttcgccagggctgggcggatgtgggaaggatgaggatggcatggacggcggagaaagagccgactctacataggatggatgttggtagatactcgggtgtggattggaaggctggatcgtacgatccggcaagctacatactagtattgctgacgagagaaacgcagaagagatatagttaacacggataaaagagaacctcgataaccctcaatcgcagtacccccgcatgttccccgcctctcatcttcacgattggcccagccagttgggggctgaaaggagtcattgacgtcaattctgcatgctctacatgctggaaggattcggcgtcagctgcagatcgcataaactggttgtgtagcatccatcacatacttaaaaagcagtccagacacaacaaacgcagtaagaaggtaagaagagtgtgtatcaattcccctccgggcagtggccaggccctcttcggagtgtctccgacagtaacccatccgggtaagagataagcttcatcggacctaataggtgaagtatatctaaaacacggctctgtcgatctcgcgaaaagcccgcggtgggttttgaggctggtttcggccacgcaatcctcaacgaatctcttgttggccaagagccattagttcccaccaaattcctcagatgtcacctaaaccttgattatttcctcagatgccatcctgcacgctcctggtatgatccacctgtattcggacagtaagagggctcgatgtggttttatgcaataaacaagcctttcatcatttgctatactgaaatagcttaaaaggaggccattgactctttataaagatcagtattttattactcctttttcgaataggggttgtttcagcttctagtagctgtacttaaatataaaaaaatacatgattttagagttgtctgcacagacgtacatacctcctgtacgataacagcgattattccccgattcggcatatcaaaaacgcgcggcacgggggaatttaatttgggtttgggtggtatccggggaaccaggcgcattggttcgtcgtgttaggagctccgccgatcagcgggagtctcggacgataggcagggggcggtagtgcttacagtcttcatggacatgtagtgacgagtgtgccaagcaccacagctatataaacatacttttggccccctactgggttcttgcagactcctctccgcagaagcttgttcggccccggaatcatattccccgtcctttgttggcagatcgacccggtccaggcatatatatcggtgccaaaaagaccccgaaggccccgatgttgaccaaaaaggattttaggtgcagccagccacttccgcccatgtatccgttggtaattgctagcggaaggagtccacgacgcaagagcagtggatcaggttgatcatggctgattatcgccaattatcaatggaaaagaatcctgctggtcaattgcctccattgtcttcggatatgagccggtgcggcgtgtttttctgcacacaaatcatgccgaatcatctctggcgaactcgatgattccgtgatgcattatcttgtttctccaacaccacaagaaatcgccgctctgcgccgagatataatctctgaaccggcgtccgagtatccgaatggataggtaactcacctccagtccttacagagacatcctctggcggataccctccacaatgcatttcaatcttctcctcgtcttgaccgtcctcctccgccaggctacggcactcgtcctgccgccgtccaacagcacctccaattcgaccggcaaattctccgcccgcaccgtcttccagttcccccagggatactggctggagaatctggccgtccggggcaatggccaggtcctcgcaaccacctacatgccgtcggccggcctgtatctcatcgaccccactcccaatgccagctatcccgcggtcctcgtccaccagttcgagaactcgacctcggccctgggcatcgtggaggcggaggggacagagcccgacaccttctatctggcgacgctgaacttctccgccgcggacggcttcgtcccccgcaccagccaggtctggcgagtggacatgtcctcgttccactactcaccccagaccgggcaggtctccgggaaggcggccgtctcgcatgttacgacgctgtcgtcggtgggcatggccaacggtatgaccctgctggctccggactcgtcgcacatcctgatcgcggactcccttcggggcgccatctgggacctggacaccgcgacgggccactatggcctctcgtcgtccttccccgccatgcggtccgacaatccggcgcgccgcttcctcgggatcgacggagtcaaggtgcaccagggcagcctgtatttcaacaatgcgggtgaattcaccctcgcccgcatgcccatccacagcgatggcatcgccaagggggagccggtcgtcctggccacggacctctacagcgatgggttctgtctgtacgacgccgacacggtgctggtgacgatgaacatcgacaacggcctcgccgcgctggacctggagagccatcgccggtggatggtggccggcaacatgcccgacggggtctttacgactccaacgtcggtcgagctgggccgcggggaggacgcgggcaaactcgcctacgtgaccatgggaggcacctacgtggcgaccggtgccgaggatctcgtcgggggcagcttagtcgtggtggacctgaagtcggccacgaccgatccgaaaggaacgggaagaggtgggctgctggtgcaggagacagagacgatttggttggagctgtagagagggggttcagtgctagaacattcagatgtactcgagtagtggtttatcatcttgaaaatagcaagctgtctactcatatatgtagtccagtatagggagagtttaaagaatgggagatatcattattaaaactgaacgataccagatacaaaaaatcattttgacccaaagtgcatcaaggtacgtcgacgtgttcctatatacatgttcctatacacatgggtcgcccgtaggcactggaaatacaaatttcacctctggcctgaaagaccctaagaaggaaaaatcatatacagagttttccgccctataaataataccttaaaggagctttcaagatgtgtccaaacacagtacccatcccctgctggtcatagcttcgccgacggcgccgtcatctcgagcactggttcggtctcccccgtgtagacgtgcgtgggccggaagaggcggattttgtttttcactgcgggcattttatcagctctcttgcccttgcttgaaagttggaaatcggctggacctacacatggactcccgataatgcgccaggatgcccaccaaccgctgtgctaccattgcaaccgggatttcctccggttggaatcccctacgacccgaccggtcaattgtcatccactgcaatcaacagaaaaacaacttacaggcgattaaagaaaaaggttccgtaaaagtccgcgttcgcatgcagttttcgtttgatgaaatactcatcggtcgacgagaggcgatcgatctcccgcgccaccttgaccagcggatccgagtccccgtccagctcgctgaagagcatatctttgatgggcttcacccgggggtcgatcgtcgtgtacgtgcgatggccgtacccaaacagccgccgcttgccagacttgacctcctccagaaaagccggcacctggtcgacgctgccgaccgcttggatggttttgtattccgcctccggggcgccaaagtgcaggggcccgtacgcagccaccagggagctgatgaggcccgagatgggatccgtcagcgaggaggcggttaccaccatcgcaaacgaggacagcgccatgccgtgctcggagttgagcgccgcaaaccgccggaagcaggacagcttcaccgggtctggacgaccggtgtacggttcaaccaggcccatcatgatgaacaggttctcaaagtaggtgttatccgtcgtggccggcgtgaaggcgatgccgcgacggtggctggccgccatgcccatcaccaccgcgtaggcggctgccgtccggagaatggcacggtcagtctgttcgggatttccatggtagatgttgcccccggcacaggctgggatggagtcggcatggtgggccagatacgcggacagcccggccacaatcatgggcatcggggggcttgtcggactgcagggggttcagttcttcattcattcaaggtgatcgtgatggacgatgaaaagcacagtagaagacctacgggaatgtctcaatcacctccgcgacatgtttgggcgtggtcgacatgagcgtggccaaggtcagacgcaacgcctctcgctgagacggcgtgggatatttgccccagaccaagagatgcagcatgtcctcgaactcggcctgccatagttgctccagggcatagccccgaaaaagcaacagcccgcgatgtccgtccctaaattgagcattagtgaaataaagaaccttcccccgggggggaactctcttggacccgttccctacgtatatgtcatgttggtctccaccacgcaggtgttcttgagacccggatcaaagacccgcaggccatcgcccactttgtccgctcgatccgcgcccaccggggacgccttgatctgcttgagatcggtggcgaggacggtgttgcgccggatggggatctcatactcccgcgatgtgcgggagtctcggatatgtagagctccatgcgacatggtgaagctgcattcatgatggatgcatgctgcattacaatttctatatatattcgacagatgatattcctcgtttatccccaggaattggtggaagcctccgtgttcatcattatcggggagttctcgtgatgtgatttcctaatgccacatgttccaatcctgtgaatgccccggaatgttgctctgccaatgagaaaatcgccgccagcgtttcaatggtggcccgggatgtagaagagcatttgaaatctcggcatttccttttcccaagaaaaagaccgagtccgccgggttctttttcgaaggaatgtgagcattgctgctgccggttcccaggtttctctgcaaagaccctttctttatactatctggaagaaatagtacgatctgttgtttctctgatgtgatctgtagctttggaacctaaatattcaaagaagaagaaaaaagaattaccttctttttctctgccttctactgccttcctgcgtagtctttctttcctttttgcagtgagtttgctaaatattcccgggatatgtttccgttacggaacgaggacgaaatacgtggctttacgaaccaacatgaaaaaggaactccgaggttgacggcaccaaatttccctcgtgacagtgcgataattatttcagtgagcatcaatacggagaaatagacccatgccaagtacaagtgtagtttttaagcgaaatcaatgctattccggtaatctctactttatagacaaaacaaacagcacaaatacaccatatactcacaggagcgtcaaagatcgaagtcaacagcatactcagtacttgatagggaatgaatacaacatcttttcagccgacctttgacgtagcgtcattatggctctctatattctattcacctttttattttccgctaacaatacttgaagctggcattcatcgtctaggcttgactagcttataccatacgaaaccagatctatcgacttttagatatcagtatgaggaaatcaaaagcaaagaaaagtaaagtctcaattgtttttactattaaactgttctttaccaggtagccttttgcaagtgatcatcagattcaacacccgtggttcttgatatctagccatgacttgagaaaaatatcagcacgctagtctccatctgatacgtaagtccctttagactagggatttgttgaaccttctgttactgaaggcaagtaaatcgcggatgatggatctgttttggtcaacatagaatggtatgttcgctcactccaggctgaaaaccagactctactgctctcgagaccaggcccactattcaatcgtcaagaacctccggtcccatttatctgaggatcaaatgcagtagcaacagacgacggcagtgtgggagtttcagagagttctgatcattgtcctgctagcctggctgctgatgctgtagacggatgagtctggtcgaggtcatgcccacacctccatatcagcacgatatagtgaccgcggagggatactttaggtccctaactccgttcaggtccgagagggcctccgcatgacgccgtcgatatcaagtcaccgttccctcctcattgcccatcctagggtccccgatataagggcaacgagcggtcagtagactctatagagttcagccatccactactttctctacatccacaacatccccatcgagtattccatcatggcctccaaggaaactttcagcaaataccctgccttccccgacaacatccccacggcggcggtccccaagatctccctccgccagattttgtcccgcgaccccaccgtgtcgaagcgtctggtcgacgcgggcaaggaattcggctgcttcaaggtcgacctgaccgatgccatcgacggccctgtcctctgtcagggcgtcgagcgcggctttgacctgggcaaggccttcttcgaccaagacatcgagaccaagaaggcatacaagctgagtcacgagaacgtcgggtaggtttctccccagccgacgtcggcccagatgatactcacccacgggtgcacaggtacaagcaggccggcgttctggtcattaccaaggagcggcgagaccaggtcgagacatgctccgtctcgcgcgatgatctggcggccagccgacccgacctgccctctgtgttcgaccagcagcggctgctgctccagggcctcgttgcgcagctcgggcagctctcgcacctggccgtctaccatctgtcggagggtctggggctggattatggagtcgtgtcggcgcgccatgatccccgcgaccagtccgccacgatgatccgtttcctgcataatccgccgcagagaggaccgcgcgaggagctgccctcgaccgaggacccgggttcgcgggcctacctgatgggccacagcgacgggggcacggtgaccatcctgttcaacgtcctgggtggactgcagctccagcgccagcagcccgatggctccatcgagtggcagtacattccgcccgagcccggctgtgccttgatcatggtgggcgacgccttcaagtccttcacggacggggaagtcccctcgtgcgtgcaccgggtcatccagccgccgggcgagcaggatcgcttcgatcggtatgcgctgggcttcttcctcaagcccgccaacggggcctccattggaccagtgccgcgccggggcgtgacggagaatggcgtcaacaaggcgtcggactatggagagtgggcaaagaacaagaacgcggcgttgtacaacgagatgcgccaggagaatgtggcaatttagatgagccagacccgacttgaagcgatagagtgatgtagtaagaggggagaaagacaatgatgcgttaaacgtaactgagatgtctacccttttgtctagaagtaggcctgtggcattcaagacggatgttgtctgtagttttgtctcggaaagtatgaacacgctaatcgccctattatcttcggattagctgcactcgggaaattcccgacctcaaactttcagcggcatttatcctggcataagaatatccagcaacactatcatgaggtatagtctgacttgcagaatgccaatgacggtatctagcaagtacagaaaaggtacgattgggaaaaccaccgatattgtgacgccgcggtctcaccgttgaacagcggaatcctccacgcctacgaaaagccccttgccggagggttggtcgagcgcgacagggtatagcgagggataggcgccttaattgaatccactaccgagccttttagctagacccaggcttcttcaaacccagcttcttgtgtagctgtacggagacgcttctcctggtcaacatcatgtccagtctgcctttctagctgcttcaccaaaagcatccttgatggcattgttaaatggcaattcgtgaggtcattttctgcagttactgcgatgcggatctggtgtgttataagatggtctctcgaaatcgtacagaggccggtgtacctgcataggaggtacagtgcttgcagtagtaaatctcttgcttatgcttgtttctcgttgcatgctcactctcctttggtggctgtgtatgctgccatcagagatcattggagtgtttctttttgcgaaaaggctcagcaggttcaacagaagatgcaggttcggttcctgggctttcagtaaccacagtacggttagagaccaagccaacaagatcgaatttagcataggaagtagtgttggaccttgtgttaatatgtggcaaacaatggaattgggccttttcaatgtagaagagcggaggtgaggggtaaagtcaacaacaagttaacaactattgtagtgaaagtagacttgttcgtggggcgggtccggtccggtcaggcgaaccgaagttaccgaaccttcttttaacccggccaagtcagctcaagacctggatgggcaattctctaacctaatctagaaagaatctctagggtcccgaggtcgggtcggatcaaaggggcggatcaccgattttgacgccgcgtcccgagccggggtcgggttaacaagtgtaaattgttaaacctaaaattgaaacagattataacagaagaagagaaatccttcatagcccttttagcattgagatagcggtcggctggatggtccgggcttgcatctatcttgagggcctgaggcgtcaatcctaacttgtgccgctactggcagtacgcgaaggtccttcggatctttcggaggggacgaatctactctatgtttattcacttcccggaattattcggatgagacactctacgtacgaccgtatcctttgtcactataattagcatatggagaaaagaaaatcagatacaaggggtgtaattcgtcatgcttcatccgtcattgattcaactatctcataacaagtctacaaacagggtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatgagctcatttaaatgaattcgaagttcctatactttctagagaataggaacttccgttaactgatattgaaggagcattttttgggcttggctggagctagtggaggtcaacaatgaatgcctattttggtttagtcgtccaggcggtgagcacaaaatttgtgtcgtttgacaagatggttcatttaggcaactggtcagatcagccccacttgtagcagtagcggcggcgctcgaagtgtgactcttattagcagacaggaacgaggacattattatcatctgctgcttggtgcacgataacttggtgcgtttgtcaagcaaggtaagtggacgacccggtcataccttcttaagttcgcccttcctccctttatttcagattcaatctgacttacctattctacctaagcattcatggccaccctcgatgacacggcttaccgctaccgtaccagcgtccccggcgacgccgaagccatcgaggccctggatggctctttcaccacggataccgtctttcgcgttaccgctaccggtgacggcttcacgctccgtgaggtgcccgtcgaccctcccctgaccaaggttttccctgatgacgaatctgacgatgaatccgacgatggcgaggacggcgatcccgactctcgcacgttcgtcgcttacggcgatgacggtgacctggccggctttgtcgttgtgtcctattccggttggaaccgtcgcctgaccgtcgaagacatcgaggttgcccccgagcatcgcggccacggtgtcggccgcgctctcatgggtctcgccacggagttcgcccgtgagcgcggcgccggtcacctctggctggaggttaccaatgtcaacgctcccgccattcacgcctaccgtcgcatgggctttaccctctgcggcctggataccgctctctacgatggcaccgcctccgatggcgagcaggccctctatatgagcatgccttgcccctgagaagttcctatactttctagagaataggaacttcgggcccatttaaatggtaccctgggcctcatgggccttccctgagagtgcaccacgcttttcaattcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaacgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatctggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcat

SEQ ID NO: 249 - DNA, 20 bp, Artificial Sequence
  primer AmpR fw (MoA 655)
ctttcaccagcgtttctggg

SEQ ID NO: 250 - DNA, 20 bp, Artificial Sequence
  primer 5' Fragment D rv (MoA 782)
gagcgtgtccaagttcaatc

SEQ ID NO: 251 - DNA, 19 bp, Artificial Sequence
  primer 3' Fragment D fw (MoA 783)
ctactctatgtttattcac

SEQ ID NO: 252 - DNA, 16 bp, Artificial Sequence
  primer PtrpC pcnat1 rv (MoA 693)
cctgtctgctaataag

SEQ ID NO: 253 - DNA, 12349 bp, Paecilomyces divaricatus
attgttaataaatcgacccattgattcgatgtacagagctgtgaactgagaatctggatgaagcgctagtaatactattgaaatccgtatacaaagataaaaatgtaggatgactgcaggtggtagttaggagccacggacctggttaagaagataccaaattgtaggggtgaatagacctaaccctggctggctagtctaggtcagtactacagtttagacaggggcaaccaggcaaaatacaattaaaataatcaccattattaactattatctacgcaattactaatgacttaactggacttagagactgaggattctacaagatttcaagaaacaaacaaaaagacatcacatacgaacgccaaaatcactagtgctccgtcaaggttttcggtccacagccccgtaacccctcggcatttggaacaaaagtctccgagtaaaccaccccgactgttatgcatcactgttgtcaaacactccgaatgtgcaatcctgccaccggcgactattccccctcgcagcacggtcatataagtctacagaaaatgttccatatctcgatgatcgtgtatatatttcttcccagccaatcgtcactgactccacgaaagtgcccggacgttcctcatgtccgagtgaagaagtcaaagtcacagtcacggatgaacttgcttctcccatctgtgaatggatatcgtccaacatggttgagaatgtctcctctccttcgtcgccacggacttcgagtccgagtggctcctgtacgcccaccagcgccaccagcgtgggatccgacgacaagagtatgcccattgctgtcgtcgggatgagctttcggggccccagggatgccatcagcgtggagagtctctggaggatgatctccgagggccgcgagggatggagtaaaatccccaagtcacgatggaataatgacgccttctaccatccggatcatagtcggcatggaacggtgagggcttccttttctttgaaagctgaacgcgaagcgagatcaaatggaaagttaaattcctaataaaaattacgagtggctaatggaaacgcttagatcaatgttgaaggagggcatttcttggaagaagatctcgctcgcttcgatgctccctttttcaatatgaccaacgcagaagcagccgtgagtattaagagatttctgacatgcaactatcgtggctgaaacccgtcaggcactggatccccaacaacgactgctactcgaaagcaccttcgaggctgtcgaaaatggtgagttgttggtctttgtttcccagaccaaaatgaatccctgacgatcgtagcgggaatacccctggacaagatgcttgggtccaagacctcctgcttcgtgggctccttctgcggcgactacaccgacatgcttgtgcgagaccccgaggccatccccatgtaccaatgcaccaacgccggtcagtcgcgggccatcacggccaaccgggtctcctacttcttcgatctgcgtgggcccagcgtcaccgttgatacggcttgctccgggagtctagttgccctccacctggcctgtcagagcttacgaacgggggatgcgaaaatggccattgtctccggggtcaataccattctgagccatgagtttatgagcactatgagcatgatgcggtaagagtcgtacccctatcgttttgcggatccagtctctcacaatgtcaggttcctgtcccccgatggacgatgttacacgtttgatgagcgggccaatggctacgcccgaggcgaaggagtcggctgtctacttctgaaacccctgtcggatgccctacgggacaatgatacgatccgcgccgtcattcgagggacgggctccaaccaggacggtaaaacgtcgggcatcaccttaccaaacgccaatgcccagcaggaattgatccgcgacgtctacgcggctgcggggctggatcctctggaaaccgagtatgtcgagtgccacggtaccggcactcaggccggcgatcctctcgagaccggcgccgtggccaaggtcttttctcctggccggccggacgatcggccgctgcgcatcggctctatcaagacgaatgtcggccacttggaaggggcgagcggcattgcaggcgtgatcaaagcggtcctgacgctggagaaccaatgtttcctcccaaatcgaaacttcaagagcattaacccgcgcattccgctcaaggagtggaaattgaaggtgcgtgagttgtcgtcgtctgctaccatcgtcgtctgctaccaacaagaaactgacatcgtcagatccaactggagaatgaacgatgggaaacagtaggcccccatcgggtctccgtcaacagtttcgggtacgggggaagcaatgcacacgccgttcttgaagacaccaagggttaccttgaacagagatccctaacaggctccttccgccgcgtacgagcgcttccccatgccgccactgacctcgagccagtctcggacccgggttctggcccagagcgtacccgactttttgtcctgtccagttttgatcaggcgtctggtcagcaacagatcgaccaactgcgggaatacttggagcagaactcctctcgaatagatgatcaatacctggcagatctcgcttacactctcggcgagcgccgctcgccctttctctggaagacggcgatgccggcatcgtccgtgtccagtctcgtcgaagggttgaagactcgcgccaaggtctctcgggccgagaagaagaagccgacgctgggcttcatcttcacgggtcaaggcgctcaatggtgcggcatgggtcgcgagcttctggcagcgtatcccgtctttgcttcgagcgtggacgctatcgccacctatctgaaaagccttggggctcccttcgacgtccgggaggagctcgtccgggatcccaaggactccaagatcaatcaaccgttgtacagccagccgatatgcaccgccgtccagattgccctggtagatctgctcaccttctggggaatccggcctgcctctgtgaccggccactccagcggcgagcttgcgggggcatacacggcaggggccctgagcatggaacacagtatggccgctgcgtattatcgaggcgttgcgtccagtgatcttccccgagaccacacgcaacgaggcgccatgatggcggtgggagccagtaaagacgccatccagccccgattgtcctcgctgacgacgggcaccgccgtggtcgcgtgcgtcaacagcccctccagcgtcaccatctcgggcgatgcatccgctgtggacgagctgcatggtttgctcgagaaggaccaggtgttcgcgcggaagttggccgtcgacgtcgcctatcactcgcaccatatgaaagccgtggccgaccaatatcgcaccgccatggccgccgccggcgtcaccgcggttcagcctgagtccacggagcccgaagtggaattcttctcgtccgtgacgggcgagaaagccagcctcaccgacctgggaatcgaatactgggtcgccaacctgctcagccaggtcaagtttgccgattccgtgcatcgcctgtgcatggagacgtcggcttccggacgggctcgcaagaccaaaaccaaggcaccgaaacgctcaggggccaacaacaaggccaaggtcgacatgctcgtcgagattggcccgcattcaacgctggcagggccaattcgccagatcctcggggccgaccagacgctggagcaggcgtcgatccgctatgccagtgccctgctgcgcaagtcgagtgcggtcgataccacgctgaccctggcgtcgaccttactgatggccgggtatccgatcgacatggctgccatcaatcgaccgtcggatcaccaccgagtgggcgtcctcgtcgatctccctccctatccgtggaaccactcgggatcatactgggcagagccgcggttgagcaaagcctatcgcaaccgcgctcatccccggaacgaccttctgggagtgttggatacgcattccagcccgcgggagccccggtggcgcaattatctccggacgagcgagatcccttggatcaaagaccatatgatccagtcgaacgtggtgtatccggcggccggctacctcaccatggcggtcgaagccatcgggcaacggattggggacaacttcccgggccaccgcatctcgggataccgactacgagatgtcgcgatcgaggcggctttggtgattagcgacgactcggagccggaggtcatgctctccttgcgtccgtctggcgacagtggcctggttccggccgaacggtggcatgaattccacgtcctttcagtgacccccgacaaccggtggacggagcattgtcgcgggctcatctgcgccgaggtcgcggccatggacggggacgaagatgaccgtggcgcagaggcagggttgaccgccgagacagagcgctggatcgaggaagcggagcagctctgccagaaagacgtcgatatcccccggttctacgcagagttgaccggtctgggtctggaatacggggagacctttgccaacatgacgcgagcacgttcggcctcccatgtctgcctcgcggagatcgaagtcgcggacactgcggctgtcatgcctctgggattccagtctccgttcgtggtccatccctccaccctggacagtctcttccatcctctcttcgtcgctctgtcctccgacgagtcactgcaagatcctgccgtgccggtggccatcgaggagatatggatccgccacggcatggccaaggaggccggacacaagttccaggtctgcgcgtcgacccaggagacgggtcgagaccgcattcaggcagctatctcggtggttgatgctcagagggctcgcagcggaccggcgttgacggtccgcggcctgacgtgccagttcctggaccgcgcatcgggagatgtcgagggcgacgagcagcctacacggcttgcatacgagcttcactgggaggcagatgtagacctgctgtcgtcgagcgacctggccacgctgtgtgcggttggccgtccccgtgatgtaggggagaaggtcgctcgatatgtgaagcttctcggacacaagaaccctcatcttgccatcctggaggtcggagccggtcagggagagctgtgtattccggtgtttcgagccctggcaggggaggccaacagcacgccctcgttccagtcatatacactcgccgacaccgagccgggactgtcggagaccattgccacaattgccgaccagtttgacgaacgcgccgatctgattcaatataaggagctcgacatctcgtcggacccgctgcagcagggcttcaacgctcactctttggacctcatccttcttccttcccggggagtgtcggccacgctccgatcgaagatcctcaaacatgcgcaccaattgctcacgcccgaagggagactgattgtggtcgacacgagggatttgcaggaatggtggcaagctcttcgtgagagcaactttactgatccggaagtgattcacgacagtccgagcgagacggaggccgacatctcggtgctggtgtcgaaaccacaaccacaacctcgggatcagaccccatcagaccctccggatgtcctggttatcgccgagaaccaagactccggcgtgtccattgagcatctccagcgtctgctggcggacgctcatgtgccggcgaccgtcacggatttcgctcatgcagacccggagggcaagacgtgcattgttctcagcgagttgacgacctctctgctgagccatcccgaccagcattcgtttgaaacgctcaaaaggatcctcgtcgccgggggtcgcggcgttctctgggtcgttcggggagcaaccggcccagcgcccaccagcagtctggccaccggtctgctgcgcacgattcgctccgagaccgacgatgatcgaccgattgtgagcctggatctggatgcctcccatcccctgtcggcggaatccgcagcgcaatcgatcttctccgcgttccgccaccgattcgtctcccccggagggagtcacgaggtcgaatacgccgaacgcgatgggatcctgcgcatccctcgcgtcgtcgagagttccctcgtcaaccacgagattgtctcgtccttgcggccggcggtggccgaggaccagccattcttccagcccggacgtccgctggaactcaccgtcggcaccccgggacgtctcgacagtctctactatgtcgaccgctcctgcatctcggagctacccagtgactacgtcgagatcgaagtcaaagccatcgggctcgggaacggcgatgtcaagaccgctctgggacatgacgatgccgcaacccgtctcggagcggaatgcagcggtgtggtgactgctctcggggacgccgtttcgggcttcaagatcggagaccgtgtcgctggctttggcgcaggaaccgtcgccactttataccgagaccaggcggcgcggttccagctcatccccgacgacatgagctttgcgcgtgcggccgctctccccgtggcatatatcactgctttcttcgcggtccacgcgctgggccaggtgagccgaggggaccgagtcctcatccaggacgccggcacggccgcgggccaggctctcctggagctctgtgccctcgccgggggggatatcatcgccgtggtggattcgccctcgcaaagagccttcctcgttggcgagtacgacctcccggcgagcagaatcctggtcggtctccgcggacgacgtctagcaaccagcgtcatgacgctgactaggggctgcggagtcgatgccatcttcaatttccgcggaggcgaggagagacgcctgtgctggagctgcgtggcaccatatggccggttcattgacctgggcggcggaccgtccgacctgacggatatgccgcagctcgagatggccagcttcttttccaagaatgcttccttcacggctctggacttccactacctggtcacgcaaaagccacaggcggtgcaccggatctggtccgacgtgatggccctggtgcgagcaaaggccatccggggcccgcccaggcttcaacttcattccgtctccgaggtcgagaccgcgttgaaacagagtcaggacggatgtgatgtcgagaaagtggtgatccgtgccgaacgggatacaatcgtccaggtctgttgccactctgccccttatgatatcctccctcgtgctaatatgttctcttgcaggccattcctcctccgaagggcgacctgctgagggccgacgcgtcatatgtgctagtcggcggcctcggaggcattggacgagcgatggcatcgtggatgattgccaacggagcccgacacttaatctttgtcaaccgcagtggcctcgcccgcaacgaagcccgggagacggtcgagtctctcgagggtcacggtgcccacgtggcggtctattcttgcgatgtcagcgatcgcgaccaagtcgctcagatggttgctcagagctccaaagagatgccgcccattcgaggcgtgattcaggcggccatgattctccgggtatgtctgccttctcgaaattagtaggtcgaggactgactgtagtaggatatgctgtttgagaaaatgagcgtcgacgacttcaacaccgtcctacagcccaaatggcagggcacatggaatcttcatggcctcctaccccgagacatggacttctttatcatgctgtcctccatcagcggggtcatcggcaacgccactcaggctgcctatgccgctgaatcgacgttcttgggcgcgttcgcccagtatcgcagctccctgggactaccggccgtgacgctggatctcggcgttatcactggaatcgggtacctgtccgagcacgaggagctgctccagggcatgcagcgacaaggctttgaaggcaccaacgagcagacgctgatggccctcatccgatcagccattgtcagccctcgtcggacggggtcacaagccgagatcgtcaccgggctggggacctggcgagagggcgtctcgctgggcaacttcgaccagcccttgttcgcgcacttccgccgtcaagccctgggactccgagatgccacggcagagggcccgggcaccagcgtccgggagagtctccggggatgcaagaccctcgacgatgcggtggctctggtctgtgcggctctgatcgaccgcctggcctcgagattgaacaccccggtggacaatatcgactcccagcgggcgatgtcggagtacggggtggactcgctggtggcggtggagatgcgcaactggatcggcaaggagatggagagcacgatgcccattctggagctgctggcgaatcaatccatctcgcagttgtcggagaagatagctcagcggtcaaaggtggtggcagtgagtggaagtgaagagtagagtatgaattgcgatttggatggttttttagttcacatcagatgacggcattgtatttatttgaataaccagaatttgatatcattatttcccaggaagtggaagacaaaaggattcaaggatatctacaatttttgcgtcaaaaattgaatgcatcgtttccttggcggttattggcatactatcaaggtcatcccgctccaatccctaaaacccagtttcaatacgccaactctggagctttttttttttttttcttctagatagttaactgtcacatcctgggatttataagaactacataatgatcgttcccctagaacttctttcaatgataaaacagaaggaaaacaaaaaaagaaagaaacaatcggcacaatcatgaatcataacttttcatcccccctcaacaccagacaaatcgagtcggagtcgcacaaggcgcggtactcagcgaggttgtcgtcactctcggcggaggcgccgagggcgtctcttcgttccgagccgtgaaataactcgccgcaataggttcctgcaaccccgcgacgtgcatgaactgggccaggttgaagcccgagcgggtgtcgacgctgatcggccgggtgctcgagaagcattcggggaagcgatatgtcgtgggctgctcaaataaaaggagcacgtaggtatggcgagggccggggaccgggcgcgggccgacataggggacgtcctcatcactcaacctcgccagccggccggtgaagggatcgcggaccttcaggtcgggctgtagccagtgcaccaggggcgttgcggtgccttcgtggttgacttcgacgtcgatcatcacggcgaggtaggactggaacacactgagaccttgccgaccgaataccggggggtcgatggcatctacacgaatcagatattagtggggaaagctctgactggtcggaagaatatatcacattaccatcgggaaggactaattggcccggttgaatgagctgctggtcacgaaatatgacatccaggcccctcggggtctttggccagtatcctggtggcgtctgggcggcgatcaaggggaggcacaccaaggccagaagaagccacaagtctggacgcatgctgcaaatggacgatagcaatagcggacagccagatcattcactgtctccatagtgtgtagtgtgtagataaggttgtggatatatatttggtggtgcagaagtcgccgtggaaagtgaccgattccccgctattatgcggacaataaagtgattcattccgactcttagaaatggttgcgtacataggtaacgtaaaagaaaagaagacaattataattaatgaagaaatggattaaatcagcatcaacgatttactacaatacaaacaggggcccggaagtttgtagctggccggataggaaaagttgcgggtgatatataaagcatgataataggtcttcacgaccggcagctttggttcatactggcacatatcctgtcttttagaatatcatgtagagctcttctgcgccatcaagtatgcagccacactacccgttgctcgaggatactgaatctctccttcaaacccattcgtatgatgtccattcagaaaatccccaagtgtatatctatgttatgagccatgagaggggcaacagccgaaaacctccctcatgatattgctcgaaaccgcaaactgagattgggaagcataacacatgaagcaatatcttcgctttgtactactgtcctcctactatcaataccaatcgcagttatgcaggtagacctgttctctgtagacgaggctgtgtcggagtcagcctggtctgcctgtgtcccgcagcagagtgtacacattaatagcctcgtcatcgcccaaagcatggccagtccaaaaggctaaatagaacagcaacgtcccagttccttatcttcttgaaagtatctagctcactttactgtacattcattctcatggccgggcggcgtaggcgaagccgcgagcatcgcaggcttcctcagccttgcggtgcggggcagacagccgcaggtgcgatcaaactctacaatttttgtaaaatgtaccaggaagtcgactccatgatcgcccagatagtagaagacgctggaagcctccatcgagctgttgcccaggtggaggagttgaccccgaagcttgttgcagcgagtccttcctccgagaaagtactcgtcccaatcaagaaacaaatcgcagagtgcaaggcagatctcagttcctggaataagagaattgattcattggggctatcgagagcgaaagggatttcagcattcaggaagaggttcaaagcaactgtggacaggtcgtttttcgagaatgtcagaagccggctttgcttccatcgggagcaactgactctgctacttacaaccgccgacgcgtatgtgactctattaccttgccgttatttatccatctaactgttggtcaagtaatgttggagttgagagcctcccgatgacaaacaaatccgagatacgttccaacttcgcgtccgggaaccgggattccaagaacctgtctcgcgtcagctcaccacgattgacaaccggataacagatcaatcagctagtttttttcctctactcaacggcagttcgataggttcttcgatggctatttggagcagggaggacaaactatatgccgtcttgaagctattgatacgaggttgcaatgcctgcaagcccggcttgagcagtcgatcaatccccaaagccagaaaacaacttacaacccgaagaagtctagaagacaagcatatgtacgacagatcccacgcaagacacggttgctggagctcgtgggctcgggaagaggtctctatcatgctcacgaaagacagaccgacattgaagaatttcctctgcgcgtgatacagactgggttgttgctcaccgagcaaaaaggaaagattatgtcgacccttctcgctcttgaggattgatgagggaggatctaggggaacggatcctgaatatgaagattgttgttattgctaggagctagctaggtgggtgaggtggaagttatcccttcctccttgggctaagcctatttagggtgtagggggccgattacttgcttcaaggatcaaaggtacagaagcgcaagtttcgaacagaagctttccatggtcagctttgtcagatctcttcggctcttgctctggttactccaaacccaaaattatctggcattcacggaggtaaggttcccaaggagatatgcctcgaatctcctggccaatgagcctttgaactcgttttggatagcctctgcaggagtaaggtacttcttcatcgtcagcaggacaaaatctcggtccggccttctcacatctgggggtctagttcccctagatcactagagagtcttaaatcaatgggtaagacgatccactatatatttgaggctacatcttgccgtggagggctataccttcatcagttgccgctcccactgtcagaagacatctctgtttgttgttctaccctgtattacggcggaccacttcctatgtcttagattgaataaacacttggtacgtctttagctcaaacaaagagaatgctgtatgaaagtcacaatgaccaacaggtcaaccaattcatatgattacgcaataatacatcgccacaagaccctgatcccaaagaagacattgacaagacatgtaaacagatccgagacaaacttcagaacaggaactgctccgccagtatgatgaaaagtggttaagcagttgtcagaaaatatagaaacgagacaaaaaccgagattcagagacggcttcacacgggcctacc

SEQ ID NO: 254 - DNA, 17373 bp, Artificial Sequence
  vector comprising Fragment F encoding for the polyketide synthase and two further proteins (SEQ IDs NO: 40-45)
actcttcctttttcaatattattgaagcatttatcagggttattgtattgttaataaatcgacccattgattcgatgtacagagctgtgaactgagaatctggatgaagcgctagtaatactattgaaatccgtatacaaagataaaaatgtaggatgactgcaggtggtagttaggagccacggacctggttaagaagataccaaattgtaggggtgaatagacctaaccctggctggctagtctaggtcagtactacagtttagacaggggcaaccaggcaaaatacaattaaaataatcaccattattaactattatctacgcaattactaatgacttaactggacttagagactgaggattctacaagatttcaagaaacaaacaaaaagacatcacatacgaacgccaaaatcactagtgctccgtcaaggttttcggtccacagccccgtaacccctcggcatttggaacaaaagtctccgagtaaaccaccccgactgttatgcatcactgttgtcaaacactccgaatgtgcaatcctgccaccggcgactattccccctcgcagcacggtcatataagtctacagaaaatgttccatatctcgatgatcgtgtatatatttcttcccagccaatcgtcactgactccacgaaagtgcccggacgttcctcatgtccgagtgaagaagtcaaagtcacagtcacggatgaacttgcttctcccatctgtgaatggatatcgtccaacatggttgagaatgtctcctctccttcgtcgccacggacttcgagtccgagtggctcctgtacgcccaccagcgccaccagcgtgggatccgacgacaagagtatgcccattgctgtcgtcgggatgagctttcggggccccagggatgccatcagcgtggagagtctctggaggatgatctccgagggccgcgagggatggagtaaaatccccaagtcacgatggaataatgacgccttctaccatccggatcatagtcggcatggaacggtgagggcttccttttctttgaaagctgaacgcgaagcgagatcaaatggaaagttaaattcctaataaaaattacgagtggctaatggaaacgcttagatcaatgttgaaggagggcatttcttggaagaagatctcgctcgcttcgatgctccctttttcaatatgaccaacgcagaagcagccgtgagtattaagagatttctgacatgcaactatcgtggctgaaacccgtcaggcactggatccccaacaacgactgctactcgaaagcaccttcgaggctgtcgaaaatggtgagttgttggtctttgtttcccagaccaaaatgaatccctgacgatcgtagcgggaatacccctggacaagatgcttgggtccaagacctcctgcttcgtgggctccttctgcggcgactacaccgacatgcttgtgcgagaccccgaggccatccccatgtaccaatgcaccaacgccggtcagtcgcgggccatcacggccaaccgggtctcctacttcttcgatctgcgtgggcccagcgtcaccgttgatacggcttgctccgggagtctagttgccctccacctggcctgtcagagcttacgaacgggggatgcgaaaatggccattgtctccggggtcaataccattctgagccatgagtttatgagcactatgagcatgatgcggtaagagtcgtacccctatcgttttgcggatccagtctctcacaatgtcaggttcctgtcccccgatggacgatgttacacgtttgatgagcgggccaatggctacgcccgaggcgaaggagtcggctgtctacttctgaaacccctgtcggatgccctacgggacaatgatacgatccgcgccgtcattcgagggacgggctccaaccaggacggtaaaacgtcgggcatcaccttaccaaacgccaatgcccagcaggaattgatccgcgacgtctacgcggctgcggggctggatcctctggaaaccgagtatgtcgagtgccacggtaccggcactcaggccggcgatcctctcgagaccggcgccgtggccaaggtcttttctcctggccggccggacgatcggccgctgcgcatcggctctatcaagacgaatgtcggccacttggaaggggcgagcggcattgcaggcgtgatcaaagcggtcctgacgctggagaaccaatgtttcctcccaaatcgaaacttcaagagcattaacccgcgcattccgctcaaggagtggaaattgaaggtgcgtgagttgtcgtcgtctgctaccatcgtcgtctgctaccaacaagaaactgacatcgtcagatccaactggagaatgaacgatgggaaacagtaggcccccatcgggtctccgtcaacagtttcgggtacgggggaagcaatgcacacgccgttcttgaagacaccaagggttaccttgaacagagatccctaacaggctccttccgccgcgtacgagcgcttccccatgccgccactgacctcgagccagtctcggacccgggttctggcccagagcgtacccgactttttgtcctgtccagttttgatcaggcgtctggtcagcaacagatcgaccaactgcgggaatacttggagcagaactcctctcgaatagatgatcaatacctggcagatctcgcttacactctcggcgagcgccgctcgccctttctctggaagacggcgatgccggcatcgtccgtgtccagtctcgtcgaagggttgaagactcgcgccaaggtctctcgggccgagaagaagaagccgacgctgggcttcatcttcacgggtcaaggcgctcaatggtgcggcatgggtcgcgagcttctggcagcgtatcccgtctttgcttcgagcgtggacgctatcgccacctatctgaaaagccttggggctcccttcgacgtccgggaggagctcgtccgggatcccaaggactccaagatcaatcaaccgttgtacagccagccgatatgcaccgccgtccagattgccctggtagatctgctcaccttctggggaatccggcctgcctctgtgaccggccactccagcggcgagcttgcgggggcatacacggcaggggccctgagcatggaacacagtatggccgctgcgtattatcgaggcgttgcgtccagtgatcttccccgagaccacacgcaacgaggcgccatgatggcggtgggagccagtaaagacgccatccagccccgattgtcctcgctgacgacgggcaccgccgtggtcgcgtgcgtcaacagcccctccagcgtcaccatctcgggcgatgcatccgctgtggacgagctgcatggtttgctcgagaaggaccaggtgttcgcgcggaagttggccgtcgacgtcgcctatcactcgcaccatatgaaagccgtggccgaccaatatcgcaccgccatggccgccgccggcgtcaccgcggttcagcctgagtccacggagcccgaagtggaattcttctcgtccgtgacgggcgagaaagccagcctcaccgacctgggaatcgaatactgggtcgccaacctgctcagccaggtcaagtttgccgattccgtgcatcgcctgtgcatggagacgtcggcttccggacgggctcgcaagaccaaaaccaaggcaccgaaacgctcaggggccaacaacaaggccaaggtcgacatgctcgtcgagattggcccgcattcaacgctggcagggccaattcgccagatcctcggggccgaccagacgctggagcaggcgtcgatccgctatgccagtgccctgctgcgcaagtcgagtgcggtcgataccacgctgaccctggcgtcgaccttactgatggccgggtatccgatcgacatggctgccatcaatcgaccgtcggatcaccaccgagtgggcgtcctcgtcgatctccctccctatccgtggaaccactcgggatcatactgggcagagccgcggttgagcaaagcctatcgcaaccgcgctcatccccggaacgaccttctgggagtgttggatacgcattccagcccgcgggagccccggtggcgcaattatctccggacgagcgagatcccttggatcaaagaccatatgatccagtcgaacgtggtgtatccggcggccggctacctcaccatggcggtcgaagccatcgggcaacggattggggacaacttcccgggccaccgcatctcgggataccgactacgagatgtcgcgatcgaggcggctttggtgattagcgacgactcggagccggaggtcatgctctccttgcgtccgtctggcgacagtggcctggttccggccgaacggtggcatgaattccacgtcctttcagtgacccccgacaaccggtggacggagcattgtcgcgggctcatctgcgccgaggtcgcggccatggacggggacgaagatgaccgtggcgcagaggcagggttgaccgccgagacagagcgctggatcgaggaagcggagcagctctgccagaaagacgtcgatatcccccggttctacgcagagttgaccggtctgggtctggaatacggggagacctttgccaacatgacgcgagcacgttcggcctcccatgtctgcctcgcggagatcgaagtcgcggacactgcggctgtcatgcctctgggattccagtctccgttcgtggtccatccctccaccctggacagtctcttccatcctctcttcgtcgctctgtcctccgacgagtcactgcaagatcctgccgtgccggtggccatcgaggagatatggatccgccacggcatggccaaggaggccggacacaagttccaggtctgcgcgtcgacccaggagacgggtcgagaccgcattcaggcagctatctcggtggttgatgctcagagggctcgcagcggaccggcgttgacggtccgcggcctgacgtgccagttcctggaccgcgcatcgggagatgtcgagggcgacgagcagcctacacggcttgcatacgagcttcactgggaggcagatgtagacctgctgtcgtcgagcgacctggccacgctgtgtgcggttggccgtccccgtgatgtaggggagaaggtcgctcgatatgtgaagcttctcggacacaagaaccctcatcttgccatcctggaggtcggagccggtcagggagagctgtgtattccggtgtttcgagccctggcaggggaggccaacagcacgccctcgttccagtcatatacactcgccgacaccgagccgggactgtcggagaccattgccacaattgccgaccagtttgacgaacgcgccgatctgattcaatataaggagctcgacatctcgtcggacccgctgcagcagggcttcaacgctcactctttggacctcatccttcttccttcccggggagtgtcggccacgctccgatcgaagatcctcaaacatgcgcaccaattgctcacgcccgaagggagactgattgtggtcgacacgagggatttgcaggaatggtggcaagctcttcgtgagagcaactttactgatccggaagtgattcacgacagtccgagcgagacggaggccgacatctcggtgctggtgtcgaaaccacaaccacaacctcgggatcagaccccatcagaccctccggatgtcctggttatcgccgagaaccaagactccggcgtgtccattgagcatctccagcgtctgctggcggacgctcatgtgccggcgaccgtcacggatttcgctcatgcagacccggagggcaagacgtgcattgttctcagcgagttgacgacctctctgctgagccatcccgaccagcattcgtttgaaacgctcaaaaggatcctcgtcgccgggggtcgcggcgttctctgggtcgttcggggagcaaccggcccagcgcccaccagcagtctggccaccggtctgctgcgcacgattcgctccgagaccgacgatgatcgaccgattgtgagcctggatctggatgcctcccatcccctgtcggcggaatccgcagcgcaatcgatcttctccgcgttccgccaccgattcgtctcccccggagggagtcacgaggtcgaatacgccgaacgcgatgggatcctgcgcatccctcgcgtcgtcgagagttccctcgtcaaccacgagattgtctcgtccttgcggccggcggtggccgaggaccagccattcttccagcccggacgtccgctggaactcaccgtcggcaccccgggacgtctcgacagtctctactatgtcgaccgctcctgcatctcggagctacccagtgactacgtcgagatcgaagtcaaagccatcgggctcgggaacggcgatgtcaagaccgctctgggacatgacgatgccgcaacccgtctcggagcggaatgcagcggtgtggtgactgctctcggggacgccgtttcgggcttcaagatcggagaccgtgtcgctggctttggcgcaggaaccgtcgccactttataccgagaccaggcggcgcggttccagctcatccccgacgacatgagctttgcgcgtgcggccgctctccccgtggcatatatcactgctttcttcgcggtccacgcgctgggccaggtgagccgaggggaccgagtcctcatccaggacgccggcacggccgcgggccaggctctcctggagctctgtgccctcgccgggggggatatcatcgccgtggtggattcgccctcgcaaagagccttcctcgttggcgagtacgacctcccggcgagcagaatcctggtcggtctccgcggacgacgtctagcaaccagcgtcatgacgctgactaggggctgcggagtcgatgccatcttcaatttccgcggaggcgaggagagacgcctgtgctggagctgcgtggcaccatatggccggttcattgacctgggcggcggaccgtccgacctgacggatatgccgcagctcgagatggccagcttcttttccaagaatgcttccttcacggctctggacttccactacctggtcacgcaaaagccacaggcggtgcaccggatctggtccgacgtgatggccctggtgcgagcaaaggccatccggggcccgcccaggcttcaacttcattccgtctccgaggtcgagaccgcgttgaaacagagtcaggacggatgtgatgtcgagaaagtggtgatccgtgccgaacgggatacaatcgtccaggtctgttgccactctgccccttatgatatcctccctcgtgctaatatgttctcttgcaggccattcctcctccgaagggcgacctgctgagggccgacgcgtcatatgtgctagtcggcggcctcggaggcattggacgagcgatggcatcgtggatgattgccaacggagcccgacacttaatctttgtcaaccgcagtggcctcgcccgcaacgaagcccgggagacggtcgagtctctcgagggtcacggtgcccacgtggcggtctattcttgcgatgtcagcgatcgcgaccaagtcgctcagatggttgctcagagctccaaagagatgccgcccattcgaggcgtgattcaggcggccatgattctccgggtatgtctgccttctcgaaattagtaggtcgaggactgactgtagtaggatatgctgtttgagaaaatgagcgtcgacgacttcaacaccgtcctacagcccaaatggcagggcacatggaatcttcatggcctcctaccccgagacatggacttctttatcatgctgtcctccatcagcggggtcatcggcaacgccactcaggctgcctatgccgctgaatcgacgttcttgggcgcgttcgcccagtatcgcagctccctgggactaccggccgtgacgctggatctcggcgttatcactggaatcgggtacctgtccgagcacgaggagctgctccagggcatgcagcgacaaggctttgaaggcaccaacgagcagacgctgatggccctcatccgatcagccattgtcagccctcgtcggacggggtcacaagccgagatcgtcaccgggctggggacctggcgagagggcgtctcgctgggcaacttcgaccagcccttgttcgcgcacttccgccgtcaagccctgggactccgagatgccacggcagagggcccgggcaccagcgtccgggagagtctccggggatgcaagaccctcgacgatgcggtggctctggtctgtgcggctctgatcgaccgcctggcctcgagattgaacaccccggtggacaatatcgactcccagcgggcgatgtcggagtacggggtggactcgctggtggcggtggagatgcgcaactggatcggcaaggagatggagagcacgatgcccattctggagctgctggcgaatcaatccatctcgcagttgtcggagaagatagctcagcggtcaaaggtggtggcagtgagtggaagtgaagagtagagtatgaattgcgatttggatggttttttagttcacatcagatgacggcattgtatttatttgaataaccagaatttgatatcattatttcccaggaagtggaagacaaaaggattcaaggatatctacaatttttgcgtcaaaaattgaatgcatcgtttccttggcggttattggcatactatcaaggtcatcccgctccaatccctaaaacccagtttcaatacgccaactctggagctttttttttttttttcttctagatagttaactgtcacatcctgggatttataagaactacataatgatcgttcccctagaacttctttcaatgataaaacagaaggaaaacaaaaaaagaaagaaacaatcggcacaatcatgaatcataacttttcatcccccctcaacaccagacaaatcgagtcggagtcgcacaaggcgcggtactcagcgaggttgtcgtcactctcggcggaggcgccgagggcgtctcttcgttccgagccgtgaaataactcgccgcaataggttcctgcaaccccgcgacgtgcatgaactgggccaggttgaagcccgagcgggtgtcgacgctgatcggccgggtgctcgagaagcattcggggaagcgatatgtcgtgggctgctcaaataaaaggagcacgtaggtatggcgagggccggggaccgggcgcgggccgacataggggacgtcctcatcactcaacctcgccagccggccggtgaagggatcgcggaccttcaggtcgggctgtagccagtgcaccaggggcgttgcggtgccttcgtggttgacttcgacgtcgatcatcacggcgaggtaggactggaacacactgagaccttgccgaccgaataccggggggtcgatggcatctacacgaatcagatattagtggggaaagctctgactggtcggaagaatatatcacattaccatcgggaaggactaattggcccggttgaatgagctgctggtcacgaaatatgacatccaggcccctcggggtctttggccagtatcctggtggcgtctgggcggcgatcaaggggaggcacaccaaggccagaagaagccacaagtctggacgcatgctgcaaatggacgatagcaatagcggacagccagatcattcactgtctccatagtgtgtagtgtgtagataaggttgtggatatatatttggtggtgcagaagtcgccgtggaaagtgaccgattccccgctattatgcggacaataaagtgattcattccgactcttagaaatggttgcgtacataggtaacgtaaaagaaaagaagacaattataattaatgaagaaatggattaaatcagcatcaacgatttactacaatacaaacaggggcccggaagtttgtagctggccggataggaaaagttgcgggtgatatataaagcatgataataggtcttcacgaccggcagctttggttcatactggcacatatcctgtcttttagaatatcatgtagagctcttctgcgccatcaagtatgcagccacactacccgttgctcgaggatactgaatctctccttcaaacccattcgtatgatgtccattcagaaaatccccaagtgtatatctatgttatgagccatgagaggggcaacagccgaaaacctccctcatgatattgctcgaaaccgcaaactgagattgggaagcataacacatgaagcaatatcttcgctttgtactactgtcctcctactatcaataccaatcgcagttatgcaggtagacctgttctctgtagacgaggctgtgtcggagtcagcctggtctgcctgtgtcccgcagcagagtgtacacattaatagcctcgtcatcgcccaaagcatggccagtccaaaaggctaaatagaacagcaacgtcccagttccttatcttcttgaaagtatctagctcactttactgtacattcattctcatggccgggcggcgtaggcgaagccgcgagcatcgcaggcttcctcagccttgcggtgcggggcagacagccgcaggtgcgatcaaactctacaatttttgtaaaatgtaccaggaagtcgactccatgatcgcccagatagtagaagacgctggaagcctccatcgagctgttgcccaggtggaggagttgaccccgaagcttgttgcagcgagtccttcctccgagaaagtactcgtcccaatcaagaaacaaatcgcagagtgcaaggcagatctcagttcctggaataagagaattgattcattggggctatcgagagcgaaagggatttcagcattcaggaagaggttcaaagcaactgtggacaggtcgtttttcgagaatgtcagaagccggctttgcttccatcgggagcaactgactctgctacttacaaccgccgacgcgtatgtgactctattaccttgccgttatttatccatctaactgttggtcaagtaatgttggagttgagagcctcccgatgacaaacaaatccgagatacgttccaacttcgcgtccgggaaccgggattccaagaacctgtctcgcgtcagctcaccacgattgacaaccggataacagatcaatcagctagtttttttcctctactcaacggcagttcgataggttcttcgatggctatttggagcagggaggacaaactatatgccgtcttgaagctattgatacgaggttgcaatgcctgcaagcccggcttgagcagtcgatcaatccccaaagccagaaaacaacttacaacccgaagaagtctagaagacaagcatatgtacgacagatcccacgcaagacacggttgctggagctcgtgggctcgggaagaggtctctatcatgctcacgaaagacagaccgacattgaagaatttcctctgcgcgtgatacagactgggttgttgctcaccgagcaaaaaggaaagattatgtcgacccttctcgctcttgaggattgatgagggaggatctaggggaacggatcctgaatatgaagattgttgttattgctaggagctagctaggtgggtgaggtggaagttatcccttcctccttgggctaagcctatttagggtgtagggggccgattacttgcttcaaggatcaaaggtacagaagcgcaagtttcgaacagaagctttccatggtcagctttgtcagatctcttcggctcttgctctggttactccaaacccaaaattatctggcattcacggaggtaaggttcccaaggagatatgcctcgaatctcctggccaatgagcctttgaactcgttttggatagcctctgcaggagtaaggtacttcttcatcgtcagcaggacaaaatctcggtccggccttctcacatctgggggtctagttcccctagatcactagagagtcttaaatcaatgggtaagacgatccactatatatttgaggctacatcttgccgtggagggctataccttcatcagttgccgctcccactgtcagaagacatctctgtttgttgttctaccctgtattacggcggaccacttcctatgtcttagattgaataaacacttggtacgtctttagctcaaacaaagagaatgctgtatgaaagtcacaatgaccaacaggtcaaccaattcatatgattacgcaataatacatcgccacaagaccctgatcccaaagaagacattgacaagacatgtaaacagatccgagacaaacttcagaacaggaactgctccgccagtatgatgaaaagtggttaagcagttgtcagaaaatatagaaacgagacaaaaaccgagattcagagacggcttcacacgggcctaccctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatgagctcatttaaatgaattcgaagttcctatactttctagagaataggaacttccgttaactgatattgaaggagcattttttgggcttggctggagctagtggaggtcaacaatgaatgcctattttggtttagtcgtccaggcggtgagcacaaaatttgtgtcgtttgacaagatggttcatttaggcaactggtcagatcagccccacttgtagcagtagcggcggcgctcgaagtgtgactcttattagcagacaggaacgaggacattattatcatctgctgcttggtgcacgataacttggtgcgtttgtcaagcaaggtaagtggacgacccggtcataccttcttaagttcgcccttcctccctttatttcagattcaatctgacttacctattctacctaagcattcatggccaccctcgatgacacggcttaccgctaccgtaccagcgtccccggcgacgccgaagccatcgaggccctggatggctctttcaccacggataccgtctttcgcgttaccgctaccggtgacggcttcacgctccgtgaggtgcccgtcgaccctcccctgaccaaggttttccctgatgacgaatctgacgatgaatccgacgatggcgaggacggcgatcccgactctcgcacgttcgtcgcttacggcgatgacggtgacctggccggctttgtcgttgtgtcctattccggttggaaccgtcgcctgaccgtcgaagacatcgaggttgcccccgagcatcgcggccacggtgtcggccgcgctctcatgggtctcgccacggagttcgcccgtgagcgcggcgccggtcacctctggctggaggttaccaatgtcaacgctcccgccattcacgcctaccgtcgcatgggctttaccctctgcggcctggataccgctctctacgatggcaccgcctccgatggcgagcaggccctctatatgagcatgccttgcccctgagaagttcctatactttctagagaataggaacttcgggcccatttaaatggtaccctgggcctcatgggccttccctgagagtgcaccacgcttttcaattcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaacgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatctggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcat

SEQ ID NO: 255 - DNA, 21 bp, Artificial Sequence
  primer 5' Fragment F rv (MoA 784)
gacaacagtgatgcataacag

SEQ ID NO: 256 - DNA, 18 bp, Artificial Sequence
  primer 3' Fragment F fw (MoA 730)
caaacttcagaacaggaa

The invention claimed is:

1. A recombinant microorganism comprising
   a) at least one expression cassette for a polypeptide having an amino acid sequence being at least 90% identical to SEQ ID NO: 13, and
   b) at least one expression cassette for a polypeptide having an amino acid sequence being at least 90% identical to SEQ ID NO: 15 or 89, and
   c) at least one expression cassette for a polypeptide having an amino acid sequence being at least 90% identical to SEQ ID NO: 17, and
   d) at least one expression cassette for a polypeptide having an amino acid sequence being at least 90% identical to SEQ ID NO: 19 and/or 105, and
   e) at least one expression cassette for a polypeptide having an amino acid sequence being at least 90% identical to SEQ ID NO: 21, and
   f) at least one expression cassette for a polypeptide having an amino acid sequence being at least 90% identical to SEQ ID NO: 23 and/or 121, and
   g) at least one expression cassette for a polypeptide having an amino acid sequence being at least 90% identical to SEQ ID NO: 25, and
   h) at least one expression cassette for a polypeptide having an amino acid sequence being at least 90% identical to SEQ ID NO: 27, and
   i) at least one expression cassette for a polypeptide having an amino acid sequence being at least 90% identical to SEQ ID NO: 29 and/or 141, and
   j) at least one expression cassette for a polypeptide having an amino acid sequence being at least 90% identical to SEQ ID NO: 31, and
   k) at least one expression cassette for a polypeptide having an amino acid sequence being at least 90% identical to SEQ ID NO: 33 and/or 158, and
   l) at least one expression cassette for a polypeptide having an amino acid sequence being at least 90% identical to SEQ ID NO: 35 and/or 169, and
   m) at least one expression cassette for a polypeptide having an amino acid sequence being at least 90% identical to SEQ ID NO: 37 and/or 180, and
   n) at least one expression cassette for a polypeptide having an amino acid sequence being at least 90% identical to SEQ ID NO: 39, and
   o) at least one expression cassette for a polypeptide having an amino acid sequence being at least 90% identical to SEQ ID NO: 41 and/or 196, and
   wherein at least one of the expression cassettes of a) to o) is a recombinant expression cassette that has been transformed into the microorganism.

2. The recombinant microorganism of claim 1, further comprising
   a) at least one expression cassette for a polypeptide having an amino acid sequence being at least 90% identical to SEQ ID NO: 7, and
   b) at least one expression cassette for a polypeptide having an amino acid sequence being at least 90% identical to SEQ ID NO: 9, and
   c) at least one expression cassette for a polypeptide having an amino acid sequence being at least 90% identical to SEQ ID NO: 43, and
   d) at least one expression cassette for a polypeptide having an amino acid sequence being at least 90% identical to SEQ ID NO: 45.

3. The recombinant microorganism of claim 2, further comprising
   a) at least one expression cassette for a polypeptide having an amino acid sequence being at least 90% identical to SEQ ID NO: 3, and
   b) at least one expression cassette for a polypeptide having an amino acid sequence being at least 90% identical to SEQ ID NO: 5, and
   c) at least one expression cassette for a polypeptide having an amino acid sequence being at least 90% identical to SEQ ID NO: 47.

4. A recombinant microorganism of claim 1, comprising
   a) at least one expression cassette for a polypeptide encoded by a nucleic acid sequence being at least 90% identical to SEQ ID NO: 12, and
   b) at least one expression cassette for a polypeptide encoded by a nucleic acid sequence being at least 90% identical to SEQ ID NO: 14, and
   c) at least one expression cassette for a polypeptide encoded by a nucleic acid sequence being at least 90% identical to SEQ ID NO: 16, and
   d) at least one expression cassette for a polypeptide encoded by a nucleic acid sequence being at least 90% identical to SEQ ID NO: 18, and
   e) at least one expression cassette for a polypeptide encoded by a nucleic acid sequence being at least 90% identical to SEQ ID NO: 20, and
   f) at least one expression cassette for a polypeptide encoded by a nucleic acid sequence being at least 90% identical to SEQ ID NO: 22, and
   g) at least one expression cassette for a polypeptide encoded by a nucleic acid sequence being at least 90% identical to SEQ ID NO: 24, and
   h) at least one expression cassette for a polypeptide encoded by a nucleic acid sequence being at least 90% identical to SEQ ID NO: 26, and
   i) at least one expression cassette for a polypeptide encoded by a nucleic acid sequence being at least 90% identical to SEQ ID NO: 28, and
   j) at least one expression cassette for a polypeptide encoded by a nucleic acid sequence being at least 90% identical to SEQ ID NO: 30, and k) at least one expression cassette for a polypeptide encoded by a nucleic acid sequence being at least 90% identical to SEQ ID NO: 32, and l) at least one expression cassette for a polypeptide encoded by a nucleic acid sequence being at least 90% identical to SEQ ID NO: 34, and m) at least one expression cassette for a polypeptide encoded by a nucleic acid sequence being at least 90% identical to SEQ ID NO: 36, and n) at least one expression cassette for a polypeptide encoded by a nucleic acid sequence being at least 90% identical to SEQ ID NO: 38, and o) at least one expression cassette for a polypeptide encoded by a nucleic acid sequence being at least 90% identical to SEQ ID NO: 40, and wherein at least one of the expression cassettes of a) to o) is a recombinant expression cassette.

5. The recombinant microorganism of claim 4, further comprising a) at least one expression cassette for a polypeptide encoded by a nucleic acid sequence being at least 90% identical to SEQ ID NO: 6, and b) at least one expression cassette for a polypeptide encoded by a nucleic acid sequence being at least 90% identical to SEQ ID NO: 8, and c) at least one expression cassette for a polypeptide encoded by a nucleic acid sequence being at least 90% identical to SEQ ID NO: 42, and d) at least one expression cassette for a polypeptide encoded by a nucleic acid sequence being at least 90% identical to SEQ ID NO: 44.

6. The recombinant microorganism of claim 5, further comprising a) at least one expression cassette for a polypeptide encoded by a nucleic acid sequence being at least 90% identical to SEQ ID NO: 2, and b) at least one expression cassette for a polypeptide encoded by a nucleic acid sequence being at least 90% identical to SEQ ID NO: 4, and c) at least one expression cassette for a polypeptide encoded by a nucleic acid sequence being at least 90% identical to SEQ ID NO: 46.

7. The recombinant microorganism of claim 6 wherein said recombinant microorganism is *Paecilomyces divaricatus*.

8. A process for the production of cornexistin or hydroxycornexistin or the production of cornexistin and hydroxycornexistin comprising the steps of:

a) cultivating the recombinant microorganism of claim 1, under conditions which allow for the production of cornexistin or hydroxycornexistin or which allow for the production of cornexistin and hydroxycornexistin by said recombinant microorganism; and b) obtaining produced cornexistin or produced hydroxycornexistin or obtaining produced cornexistin and hydroxycornexistin.

9. The process of claim 8, wherein cornexistin or hydroxycornexistin or cornexistin and hydroxycornexistin are obtained from the culture broth.

10. The process according to claim 9, wherein at least one of cornexistin or hydroxycornexistin is obtained as dibasic acid thereof or in the form of its agriculturally acceptable salt.

11. The recombinant microorganism of claim 1, wherein said recombinant microorganism is a fungal organism.

12. The recombinant microorganism of claim 3, wherein said recombinant microorganism is a fungal organism.

13. The recombinant microorganism of claim 3, wherein said recombinant microorganism is *Paecilomyces divaricatus*.

14. The recombinant microorganism of claim 4, wherein said recombinant microorganism is a fungal organism.

15. The recombinant microorganism of claim 4, wherein said recombinant microorganism is *Paecilomyces divaricatus*.

16. The recombinant microorganism of claim 6, wherein said recombinant microorganism is a fungal organism.

17. The recombinant microorganism of claim 6, wherein said recombinant microorganism is *Paecilomyces divaricatus*.

18. The process of claim 8, wherein a recombinant microorganism of claim 7 is cultivated.

19. The process of claim 18, wherein cornexistin or hydroxycornexistin or cornexistin and hydroxycornexistin are obtained from the culture broth.

20. The process according to claim 19, wherein at least one of cornexistin or hydroxycornexistin is obtained as dibasic acid thereof or in the form of its agriculturally acceptable salt.

* * * * *